(12) United States Patent
Watters et al.

(10) Patent No.: US 8,392,127 B2
(45) Date of Patent: Mar. 5, 2013

(54) METHODS AND GENE EXPRESSION SIGNATURE FOR ASSESSING GROWTH FACTOR SIGNALING PATHWAY REGULATION STATUS

(75) Inventors: James Watters, Chalfont, PA (US); Andrey Loboda, Philadelphia, PA (US); Michael Nebozhyn, Yeadon, PA (US)

(73) Assignee: Merck Sharp & Dohme Corp., Rahway, NJ (US)

( * ) Notice: Subject to any disclaimer, the term of this patent is extended or adjusted under 35 U.S.C. 154(b) by 34 days.

(21) Appl. No.: 12/933,936

(22) PCT Filed: Mar. 19, 2009

(86) PCT No.: PCT/US2009/037598
§ 371 (c)(1),
(2), (4) Date: Sep. 22, 2010

(87) PCT Pub. No.: WO2009/120561
PCT Pub. Date: Oct. 1, 2009

(65) Prior Publication Data
US 2011/0015869 A1    Jan. 20, 2011

Related U.S. Application Data

(60) Provisional application No. 61/070,368, filed on Mar. 22, 2008, provisional application No. 61/128,001, filed on May 16, 2008, provisional application No. 61/132,649, filed on Jun. 20, 2008.

(51) Int. Cl.
*G06F 19/00* (2011.01)
*C12N 15/11* (2006.01)
*C12Q 1/68* (2006.01)

(52) U.S. Cl. .......... 702/19; 435/6.1; 435/6.13; 536/24.3
(58) Field of Classification Search .................. None
See application file for complete search history.

(56) References Cited

U.S. PATENT DOCUMENTS

| | | |
|---|---|---|
| 2005/0084872 A1 | 4/2005 | Lum et al. |
| 2006/0078900 A1* | 4/2006 | Mendrick et al. ............ 435/6 |
| 2006/0211025 A1 | 9/2006 | Su et al. |
| 2007/0299030 A1 | 12/2007 | Dmitrovsky |

FOREIGN PATENT DOCUMENTS

| | | |
|---|---|---|
| WO | 2005005601 A2 | 1/2005 |
| WO | 2006124836 A1 | 11/2006 |
| WO | 2007038792 A2 | 4/2007 |

OTHER PUBLICATIONS

GenBank Accession No. NM_004237 (1995); pp. 1-4.*
GenBank Accession No. BC0457528 (2002); pp. 1-6.*
GenBank Accession No. BC009408 (2006); pp. 1-3.*
GenBank Accession No. BC044862 (2002); pp. 1-12.*
GenBank Accession No. NM_005730 (1994); pp. 1-6.*
GenBank Accession No. NP_660278 (2003); pp. 1-3.*
Kostourou, V et al., Cancer Research, vol. 63, (2003), pp. 4960-4966, "Effects of overexpression of dimethylarginine dimethylaminohydrolase on tumor angiogenesis assessed by susceptibility magnetic resonance imaging".
Zhang, Y et al., Bioinformatics, vol. 20(15), (2004), pp. 2390-2398, "GEPIS—Quantitative gene expression profiling in normal and cancer tissues".
Xu, J et al., Oncogene, vol. 26(20), (2007), pp. 2925-2938, "Effect of AKT inhibition on scatter factor-regulated gene expression in DU-145 human prostate cancer cells".
Ishida, S et al., Biochemical Pharmacology, Oxford, vol. 68(11), (2004), pp. 2177-2186, "Differential modulation of PI3-kinase/Akt pathway during all-trans retinoic acid- and Am80-induced HL-60 cell differentiation revealed by DNA microarray analysis".
Tullai, JW, Journal of Biological Chemistry, vol. 279(19), (2004), pp. 20167-20177, "Identification of transcription factor binding sites upstream of human genes regulated by the phosphatidylinositol 3-kinase and MEK/ERK signaling pathways".
Bild, Ah et al., Nature, vol. 439(7074), (2006), pp. 353-357, "Oncogenic pathway signatures in human cancers as a guide to targeted therapies".

* cited by examiner

*Primary Examiner* — Lori A Clow
(74) *Attorney, Agent, or Firm* — Laura M. Ginkel; David A. Muthard

(57) ABSTRACT

Methods, biomarkers, and expression signatures are disclosed for assessing the regulation status of growth factor pathway signaling in a cell sample or subject. More specifically, several aspects of the invention provide a set of genes which can be used as biomarkers and gene signatures for evaluating growth factor pathway deregulation status in a sample; classifying a cell sample as having a deregulated or regulated growth factor signaling pathway; determining whether an agent modulates the growth factor signaling pathway in sample; predicting response of a subject to an agent that modulates the growth factor signaling pathway; assigning treatment to a subject; and predicting evaluating the pharmacodynamic effects of cancer therapies designed to regulate growth factor pathway signaling.

7 Claims, 40 Drawing Sheets

Figure 1:
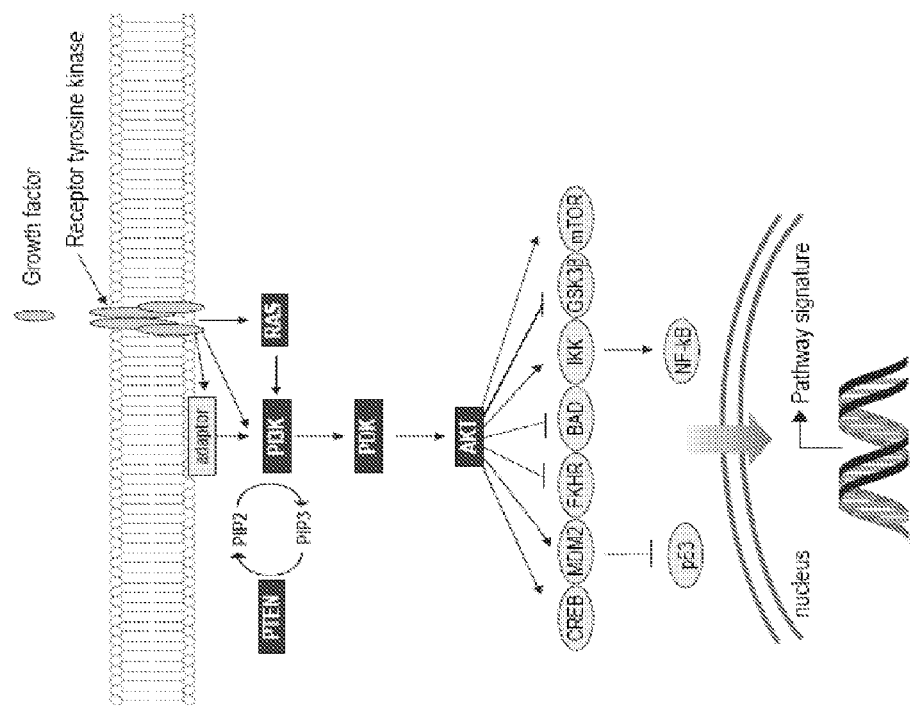

METHODS AND GENE EXPRESSION SIGNATURE FOR ASSESSING GROWTH FACTOR SIGNALING PATHWAY REGULATION STATUS

This application claims priority to U.S. Provisional Patent Application Ser. No. 61/070,368 filed on Mar. 22, 2008, U.S. Provisional Patent Application Ser. No. 61/128,001 filed on May 16, 2008, and U.S. Provisional Patent Application Ser. No. 61/132,649 filed on Jun. 20, 2008, each of which is incorporated by reference herein in its entirety.

This application includes a Sequence Listing which is incorporated by reference herein in its entirety.

1. BACKGROUND OF THE INVENTION

The identification of patient subpopulations most likely to respond to therapy is a central goal of modern molecular medicine. This notion is particularly important for cancer due to the large number of approved and experimental therapies (Rothenberg et al., 2003, Nat. Rev. Cancer 3:303-309), low response rates to many current treatments, and clinical importance of using the optimal therapy in the first treatment cycle (Dracopoli, 2005, Curr. Mol. Med. 5:103-110). In addition, the narrow therapeutic index and severe toxicity profiles associated with currently marketed cytotoxics results in a pressing need for accurate response prediction. Although recent studies have identified gene expression signatures associated with response to cytotoxic chemotherapies (Folgueria et al., 2005, Clin. Cancer Res. 11:7434-7443; Ayers et al., 2004, 22:2284-2293; Chang et al., 2003, Lancet 362:362-369; Rouzier et al., 2005, Proc. Natl. Acad. Sci. USA 102: 8315-8320), these examples (and others from the literature) remain unvalidated and have not yet had a major effect on clinical practice. In addition to technical issues, such as lack of a standard technology platform and difficulties surrounding the collection of clinical samples, the myriad of cellular processes affected by cytotoxic chemotherapies may hinder the identification of practical and robust gene expression predictors of response to these agents. One exception may be the recent finding by microarray that low mRNA expression of the microtubule-associate protein Tau is predictive of improved response to paclitaxel (Rouzier et al., supra).

To improve on the limitations of cytotoxic chemotherapies, current approaches to drug design in oncology are aimed at modulating specific cell signaling pathways important for tumor growth and survival (Hahn and Weinberg, 2002, Nat. Rev. Cancer 2:331-341; Hanahan and Weinberg, 2000, Cell 100:57-70; Trosko et al., 2004, Ann. N.Y. Acad. Sci. 1028: 192-201). In cancer cells, these pathways become deregulated resulting in aberrant signaling, inhibition of apoptosis, increased metastasis, and increased cell proliferation (reviewed in Adjei and Hildalgo, 2005, J. Clin. Oncol. 23:5386-5403). Though normal cells integrate multiple signaling pathways for controlled growth and proliferation, tumors seem to be heavily reliant on activation of one or two pathways ("oncogene activation"). In addition to the well-known dependence of chronic myelogenous leukemia on BCR-ABL, studies of the epidermal growth factor receptor and MYC pathways showed that inactivation of a single critical oncogene can induce cell death or differentiation into cells with a normal phenotype (Lynch et al., 2004, N. Engl. J. Med. 350: 2129-2139; Paez et al., 2004, Science 304:1497-1500; Weinstein, 2002, Science 297:63-64; Jain et al., 2002, Science 297:102-104; Gorre et al., 2001, Science 293:876-880; Druker et al., 2001, N. Engl. J. Med. 344:1031-1037). The components of these aberrant signaling pathways represent attractive selective targets for new anticancer therapies. In addition, responder identification for target therapies may be more achievable than for cytotoxics, as it seems logical that patients with tumors that are "driven" by a particular pathway will respond to therapeutics targeting components of that pathway. Therefore, it is crucial that we develop methods to identify which pathways are active in which tumors and use this information to guide therapeutic decisions. One way to enable this is to identify gene expression profiles that are indicative of pathway activation status.

Current methods for assessing pathway activation in tumors involve the measurement of drug targets, known oncogenes, or known tumor suppressors. However, one pathway can be activated at multiple points, so it is not always feasible to assess pathway activation by evaluating known cancer-associated genes (Downard, 2006, Nature 439:274-275). To illustrate this situation, consider signaling through phosphatidylinositol 3-kinase (PI3K; FIG. 1). This pathway is activated by multiple growth factors through receptor tyrosine kinases and has effects on multiple processes, including cell growth and survival, metastatic competence, and therapy resistance. PI3K signaling is often activated in human cancers, and many pharmaceutical companies are developing inhibitors of one or more pathway components (Hennessy et al., 2005, Nat. Rev. Drug Discov. 4:988-1004). Therefore, accurate determination of PI3K pathway activation will be critical for the identification of potential responders to these emerging novel therapeutics.

However, the PI3K pathway can be activated by aberrations at multiple points, and assessing pathway activity may not be straightforward (Cully et al., 2006, Nat. Rev. Cancer 6: 184-192). For example, PI3K itself is frequently mutated in cancers. PI3K somatic missense mutations are common in HER2-amplified, hormone receptor-positive breast cancers, and PI3K mutation/amplification has been observed in ovarian cancer, gastric cancer, lung cancer, brain cancer, etc. (Bachman et al., 2004, Cancer Biol. Ther. 3:772-775; Samuels et al., 2004, Science 304:554; Campbell et al, 2004, Cancer Res. 64:7678-7681; Mizoguchi et al., 2004, Brain Pathol. 14:372-377; Shayesteh et al., 1999, Nat. Genet. 21:99-102; Woenckhaus et al., 2002, J. Pathol. 198:335-342). In addition, activating mutations in RAS occur in pancreatic and lung cancers (Johnson and Heymach, 2004, Clin. Cancer Res. 10:4254-4257), and a recent large-scale sequencing project in colorectal cancers recently identified novel infrequent mutations in PDK1 (Parsons et al., 2005, Nature 436: 792). Finally, AKT (activation, amplification) and PTEN (mutation, deletion, epigenetic inactivation) are also deregulated in many human cancers (Altomare et al., 2003, J. Cell Biochem. 88:470-476; Ruggeri et al., 1998, Mol. Carcinog. 21:81-86; Cheng et al., 1996, Proc. Natl. Acad. Sci. USA 93:3636-3641; Staal et al., 1987, Proc. Natl. Acad. Sci. USA 84:5034-5037; Li et al., 2005, World J. Gastroenterol. 11:285-288; Li et al., 1997, Science 275:1943-1947; Goel et al., 2004, 64:3014-3021). Although PI3K pathway activation can be assessed by immunohistochemical analysis of PTEN or phosphorylated AKT levels in clinical samples (Slipicevic et al., 2005, Am. J. Clin. Pathol. 124:528-536), this may not be the optimal way to measure pathway activation. These assays are subject to the technical limitations of immunohistochemistry and are not quantitative. In addition, oncogenic pathways are complex (e.g., RAS signaling contributes to PI3K activation), so important pathway mediators may be missed by testing only a few well-characterized pathway components. The difficulty in measuring PI3K pathway activation by these means is reflected by inconsistent results reported in the literature when individual pathway components are analyzed in isolation (Saal et al., 2005, Cancer Res. 65:2554-2559; Panigrahi et al., 2004, J. Pathol. 204:93-100).

Examples like this suggest that a gene expression signature-based readout of pathway activation may be more appropriate than relying on a single indicator of pathway activity, as the same signature of gene expression may be elicited by activation of multiple components of the pathway. In addition, by integrating expression data from multiple genes, a quantitative assessment of pathway activity may be possible. In addition to using gene expression signatures for tumor classification by assessing pathway activation status, gene expression signatures for pathway activation may also be used as pharmacodynamic biomarkers, i.e. monitoring pathway inhibition in patient tumors or peripheral tissues post-treatment; as response prediction biomarkers, i.e. prospectively identifying patients harboring tumors that have high levels of a particular pathway activity before treating the patients with inhibitors targeting the pathway; and as early efficacy biomarkers, i.e. an early readout of efficacy.

2. BRIEF DESCRIPTION OF THE DRAWINGS

FIG. 1. PI3K pathway activation and gene expression signatures. PI3K is activated by growth factors through receptor tyrosine kinases. In addition, PI3K can be activated by RAS, resulting in cross-talk with other signaling cascades (data not shown). On activation, PI3K phosphorylates phosphatidylinositol-4,5-bisphosphate (PIP2) to phsophatidylinositol-3,4,5-triphosphate (PIP3), a process that is reversed by PTEN. PIP3 signals activate the kinase PDK1, which in turn activates the kinase AKT. This signaling cascade affects multiple cellular processes and results in a gene expression "signature" of pathway activity. Activation of this pathway has been implicated in many cancers, and this activation can occur via aberrations in multiple pathway components (dark gray). Because activation of various pathway components may lead to the same gene expression profile, a signature of pathway activation is likely to provide more accurate information than the assessment of a single known oncogene or tumor suppressor.

Figure 2:
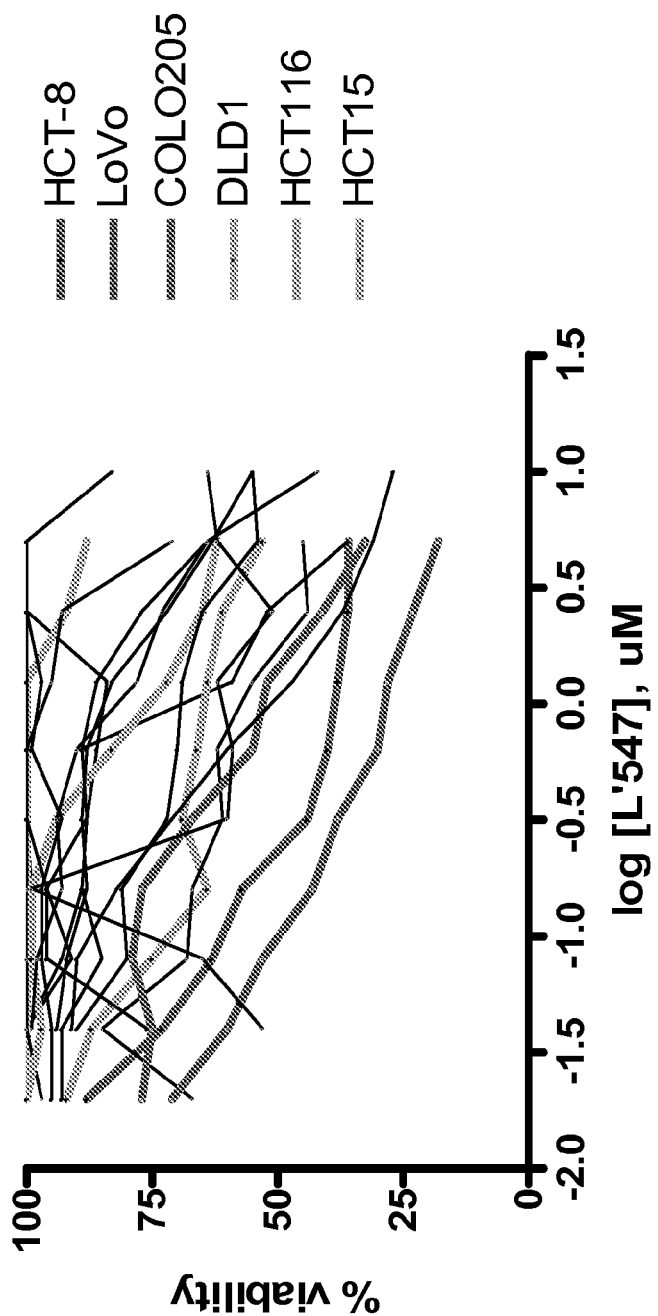

FIG. 2. Cell lines used as a starting point for signature gene discovery. Nineteen colon cancer cell lines were phenotyped for sensitivity to the AKT1/2 inhibitor L-001154547. Three of the more sensitive cell lines (HCT-8, LoVo, COLO205, shown in bold dark gray) and three of the more resistance cell lines (DLD1, HCT116, HCT15, shown in bold light gray) were chosen for post-treatment expression profiling.

Figures 3A, 3B:
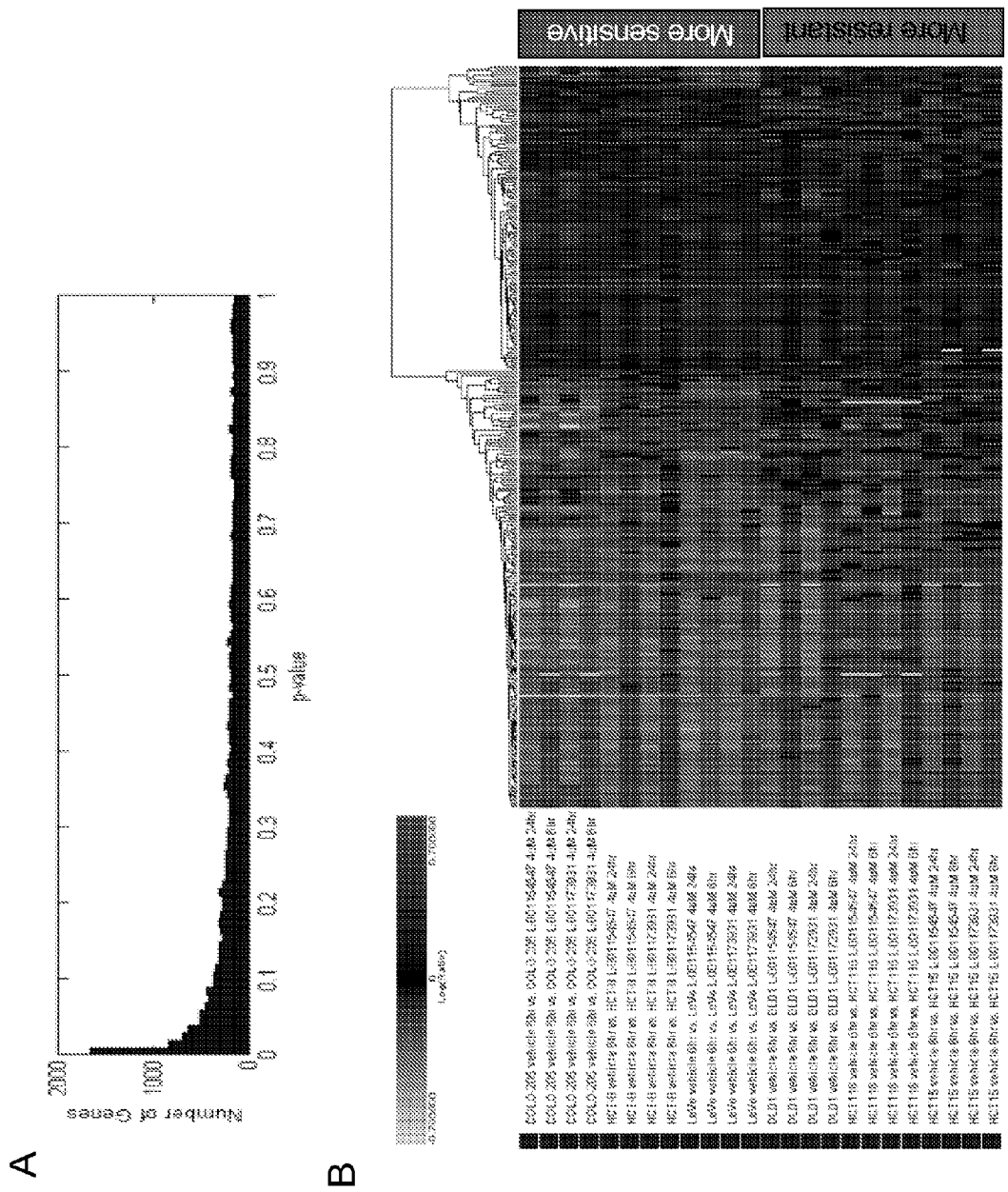

FIG. 3. Initial discovery of genes sensitive to inhibition of AKT1/2. FIG. 3A. The P-value distribution for genes identified as being differentially expressed in an ANOVA calculation comparing post-treatment changes between more sensitive and more resistance cell lines is shown. 1,600 genes were differentially expressed at p<0.01. FIG. 3B. 1-dimensional heatmap showing the regulation of 399 genes identified from FIG. 3A that were also correlated (r>0.7) with IRS2 expression across this dataset. Expression data is represented at log 10 ratio relative to vehicle treatment. The sensitivity and resistance grouping are relative, as all cell lines showed some degree of cell killing.

FIG. 4. Feedback regulation observed during analysis of AKT inhibitor-induced profiles. (A) ERBB3, IRS1, ERBB2, INSR, IRS2, FGFR1 and EGFR all showed evidence of upregulation (p<0.05 in at least one experiment) in response to inhibitors of AKT1/2 in cell lines that were sensitive to AKT inhibition. Expression data is represented at $log_{10}$ ratio relative to vehicle treatment. Each of these genes is upstream of AKT and each is known to lead to activation of PI3K/AKT signaling when they are activated by growth factors. (B) One hypothesis for observing feedback regulation is that short term, acute inhibition of AKT leads to significant alterations in molecules that normally relay AKT signals. In response, the cell upregulates the expression of upstream genes that activate signaling through AKT. (C) In order to identify genes that responded in the same direction to AKT signaling changes in vitro and in vivo, we re-ratioed data from the colon expression tumor atlas to produce one profile of gene expression for each tumor relative to its adjacent normal sample. Here, we show genes that were downregulated by AKT inhibitors in vitro, but showed upregulation (mean log ratio>0.2 on average across the entire dataset) in colon tumors relative to adjacent normal tissue.

FIG. 5. The AKT signature score in breast tumors. Using the AKT signature genes identified in colon cancer cell lines and colon tumors, we calculated the AKT signature score in human breast cancer datasets. The following formula was used: mean log ratio (genes down-regulated by AKT inhibition in vitro)–mean log ratio (genes up-regulated by AKT inhibition in vitro). (A) The AKT signature score separates breast tumors from normal tissue in the breast tumor atlas, with tumors exhibiting higher AKT pathway activity on average than normal tissue. In addition, a large range of AKT signature score is observed in breast tumors.

FIG. 6. Relationship of AKT and MYC signatures. The AKT and MYC signature scores are highly correlated in the (A) colon (r=0.81) and (B) breast (r=0.82) tumor atlas datasets. The AKT signature score was calculated as described previously. The MYC signature score was calculated using the following formula: mean log ratio (genes up-regulated by MYC overexpression in Bild et al., 2006, Nature 439:353-357)–mean log ratio (genes down-regulated by MYC overexpression in Bild et al). (C) The Bild et al. MYC signature is inhibited by small molecule inhibitors of AKT, cMET and FGFR2, but not by taxol or inhibition of KSP. The magenta rectangle represents genes that were down-regulated by MYC overexpression in Bild et al., and the cyan rectangle represents genes that were up-regulated by MYC overexpression in Bild et al. Inhibition of AKT, cMET or FGFR2 leads to inverse regulation of MYC signature genes compared to regulation caused by MYC overexpression. Experiments are listed on the left side of the heatmap (HCT116: colon cancer cells, LoVo: colon cancer cells, GTL-16: gastric cancer cells, EBC-1: lung cancer cells, KATO III: gastric cancer cells, SUM52: breast cancer cells). The drug (taxol) or drug target (all others) profiled in each experiment is indicated along the right side of the heatmap.

Figure 7:
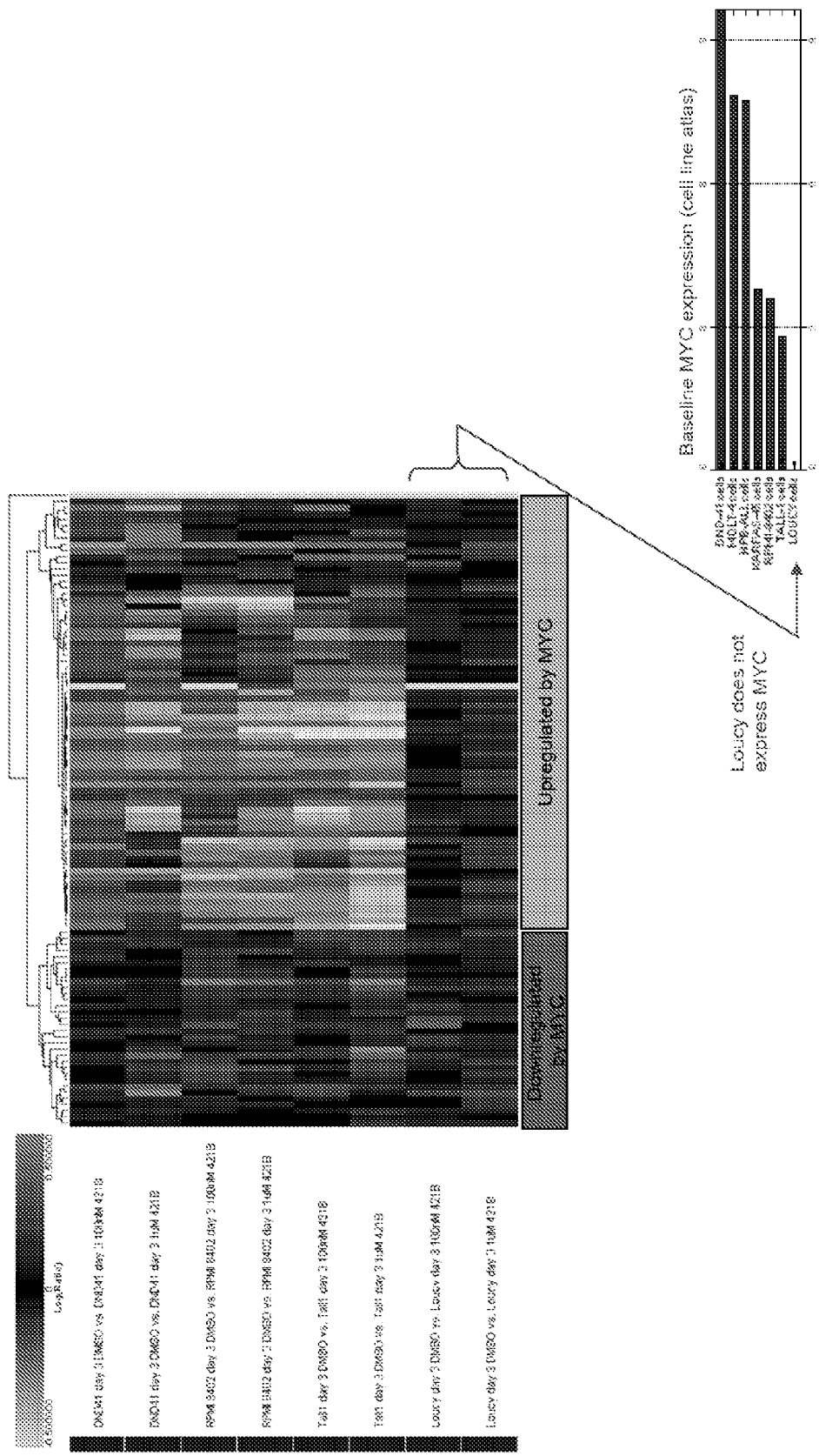

FIG. 7. Inhibition of Gamma-Secretase results in inhibition of the Bild et al. (2006, Nature 439:353-357) MYC signature. T-ALL cell lines were profiled after 3 or 7 days of treatment with 100 nM or 1 uM concentrations of 421B. The magenta rectangle represents genes that were downregulated by MYC overexpression in Bild et al, and the cyan rectangle represents genes that were upregulated by MYC overexpression in Bild et al. Gamma-secretase inhibition leads to inverse regulation of MYC signature genes compared to regulation caused by MYC overexpression, except in Loucy cells. The lower panel shows data from the cell line atlas demonstrating that Loucy cells do not express MYC (MYC levels at baseline are below the threshold of detection, indicated by the ball and stick). As such, inhibition of the MYC signature is not expected in this cell line.

FIG. 8. Identification of a novel MYC signature. (A) Genes showing at least 2-fold change in all cMET inhibitor IC90 samples were analyzed using Ingenuity. MYC was a central hub of the most significant interaction network formed by the data ($p<1\times10^{-64}$), with MYC itself and 21 interaction partners identified. Nodes with asterisks were upregulated by cMET inhibition (and are known to be associated with decreased MYC activity), whereas nodes without asterisks were downregulated by cMET inhibition (and are known to be associated with increased MYC activity). (B) Building upon the Ingenuity analysis, we focused on 18 genes known to transcriptionally activate or repress MYC signaling to identify a novel MYC signature. This heatmap shows that the novel MYC signature, like that of Bild et al. (see FIG. 5C) is inhibited by inhibitors of growth factor signaling, but not by mitotic inhibitors. Only gene models present on all arrays are shown. Experiments are listed on the left side of the heatmap. The drug (taxol) or drug target (all others) profiled in each experiment is indicated along the right side of the heatmap.

Figure 9:
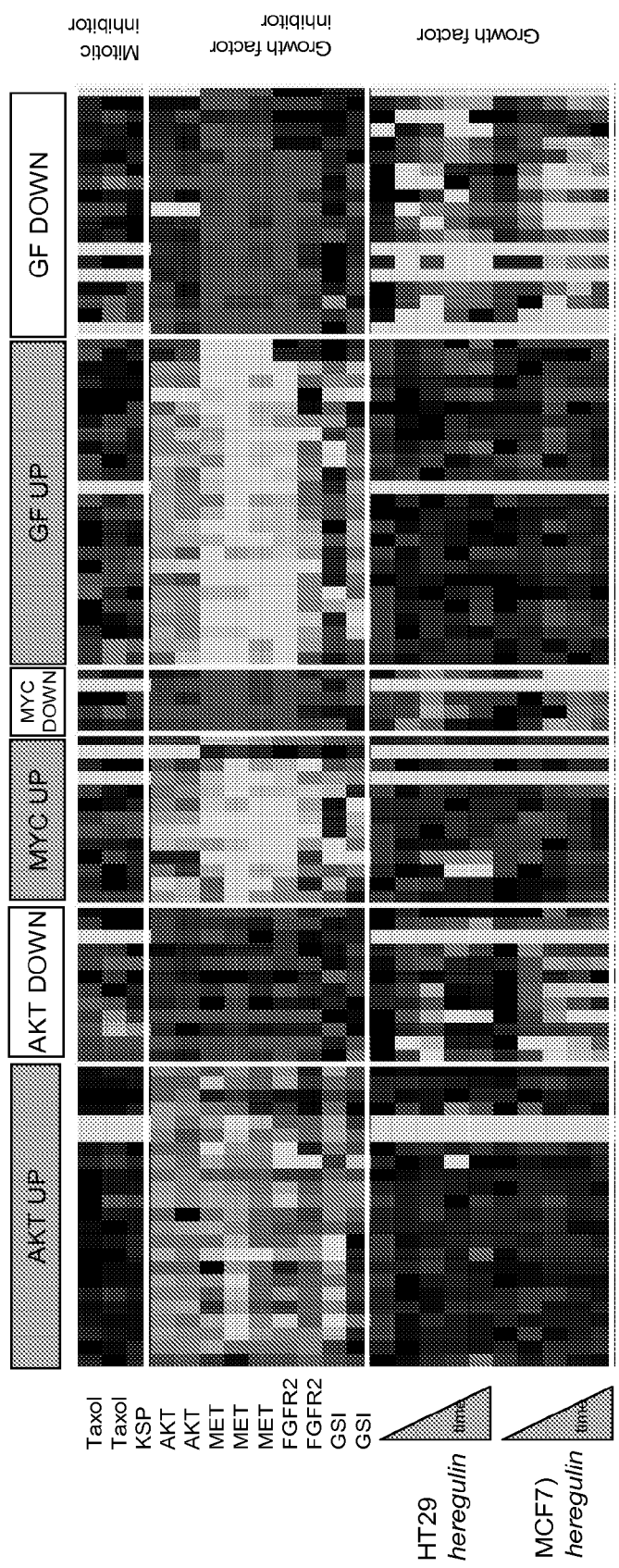

FIG. 9. Inverse regulation of the growth factor signaling pathway signature by growth factors relative to growth factor pathway inhibitors. Genes listed in Table 5 are shown along the Y-axis, and various treatments are listed along the X-axis. The drug treatment/drug targets are listed along the left hand side, and functional groupings are listed along the right hand side. Mitotic inhibitors do not show consistent regulation of the growth factor signaling genes, whereas the growth factor pathway inhibitors show robust regulation as described in the examples. From the growth factor compendium, we show data from both colon (HT29) and breast (MCF7) cells treated with heregulin (a growth factor that binds to Erbb family receptors and activates PI3K/AKT signaling). Cells were treated with heregulin for 0.5, 2, 6, 18, or 24 hours. Note the inverse regulation of the signature genes by heregulin in both cell lines compared to the regulation by inhibitors of growth factor signaling.

Figure 10:
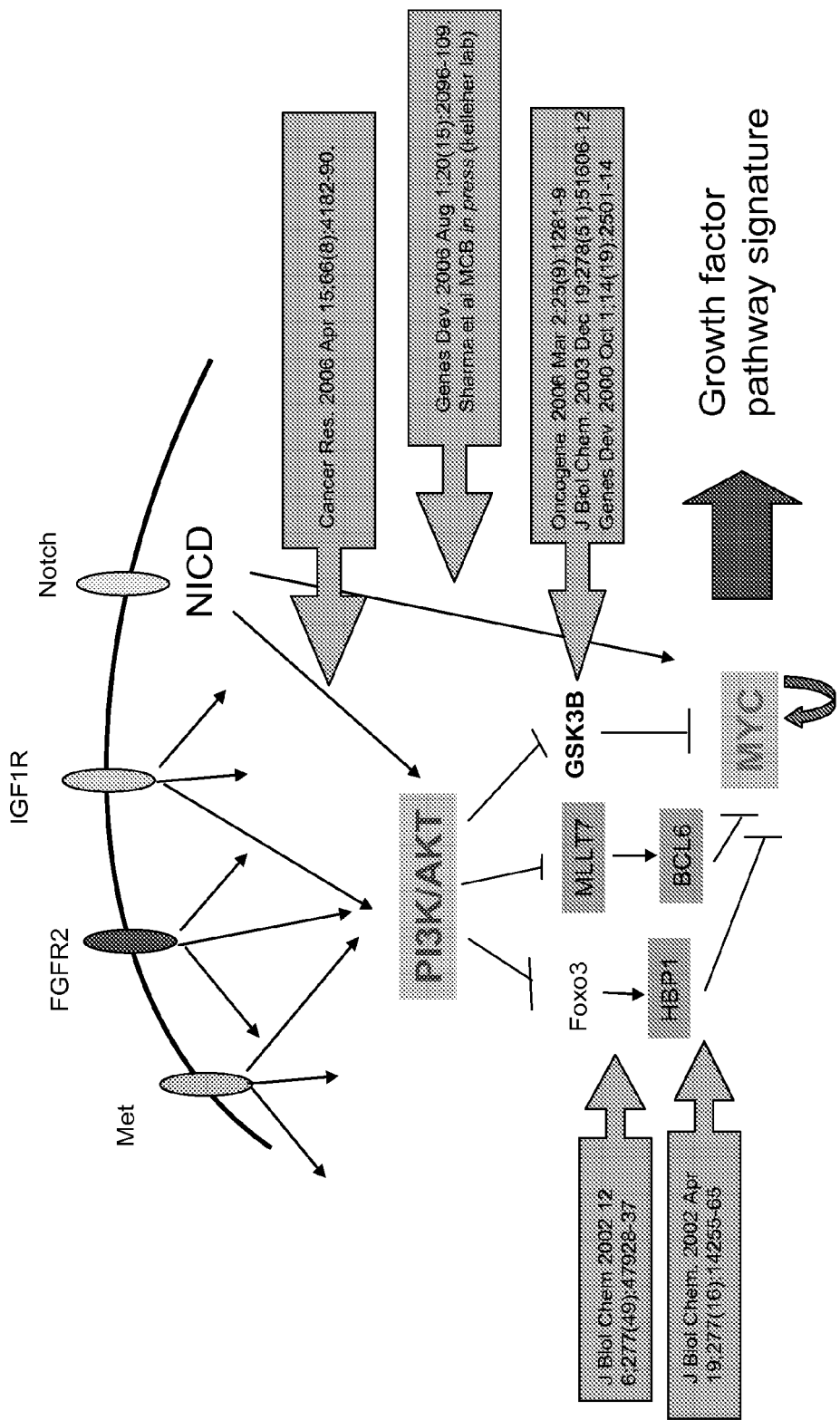

FIG. 10. Potential mechanisms underlying the consistent regulation of the same signature by multiple interventions. Links between cell surface receptors (Met, FGFR2, IGF1R and Notch) are shown, with supporting literature shown. Growth factor receptors and Notch intracellular domain (NICD) all activate signaling through PI3K/AKT. This leads to MYC activation through the activity of GSK3B, and through regulation of forkhead transcription factors (among other possible links). The forkhead transcription factor MLLT7 and the forkhead targets HBP1 and BCL6 are all part of the MYC signature (see Example 3) (upregulated when MYC signaling is inhibited). Therefore, intervention at multiple points along the growth factor signaling cascade can culminate in and lead to similar patterns of gene expression once signals are relayed to the nucleus.

FIG. 11. CFU assay for oncotest tumors. 14 tumor lines were tested for sensitivity to cMET inhibitor MK-2461 in a colony-formation assay. A) cMET mRNA expression was tested for its ability to predict response to MK-2461. The tumor that was most sensitive to MK-2461 treatment had low expression of cMET. B) The growth factor signaling pathway signature was also tested for its ability to predict response to MK-2461. The most sensitive tumor had the highest baseline growth factor signaling pathway signature score. These data suggest that the growth factor signaling pathway signature is a better predictor of MK-2461 sensitivity than mRNA expression of cMET, and that the signature could be used to predict response to treatment with MK-2461.

Figure 12:
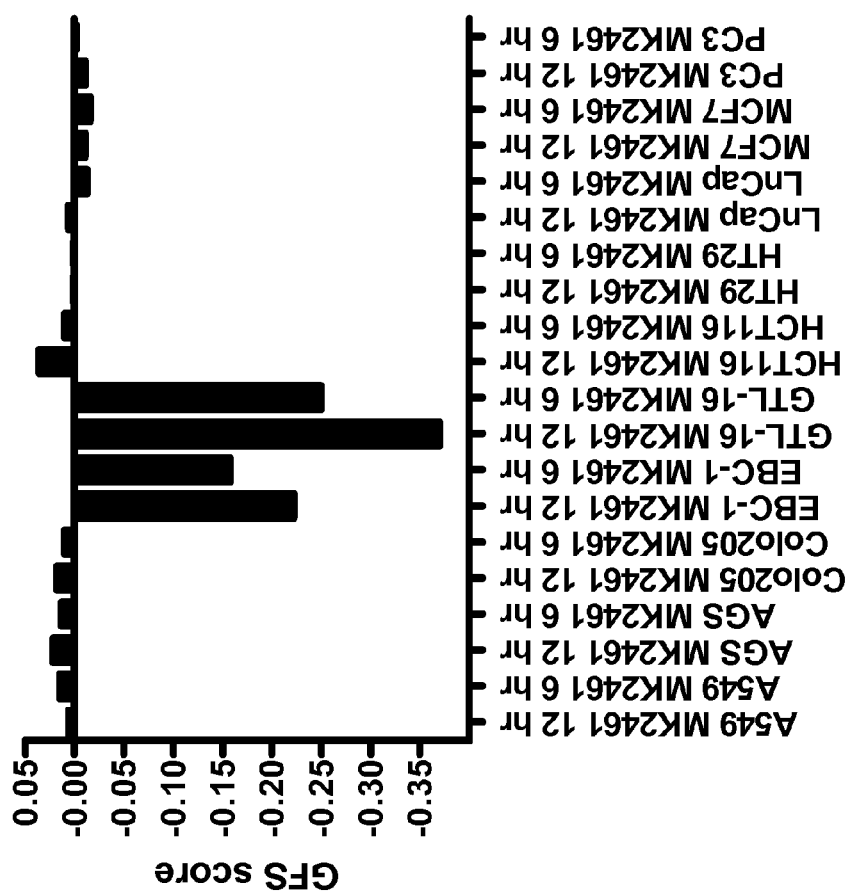

FIG. 12. Early efficacy experiments for cMET inhibitor MK-2461 in cell lines. Inhibition of the growth factor signaling pathway signature was observed in two cell lines, EBC-1 and GTL-16. These two cell lines are the only ones in the assay sensitive to inhibition with MK-2461, suggesting that the growth factor signaling pathway signature could be used as an early readout of efficacy.

Figure 13:
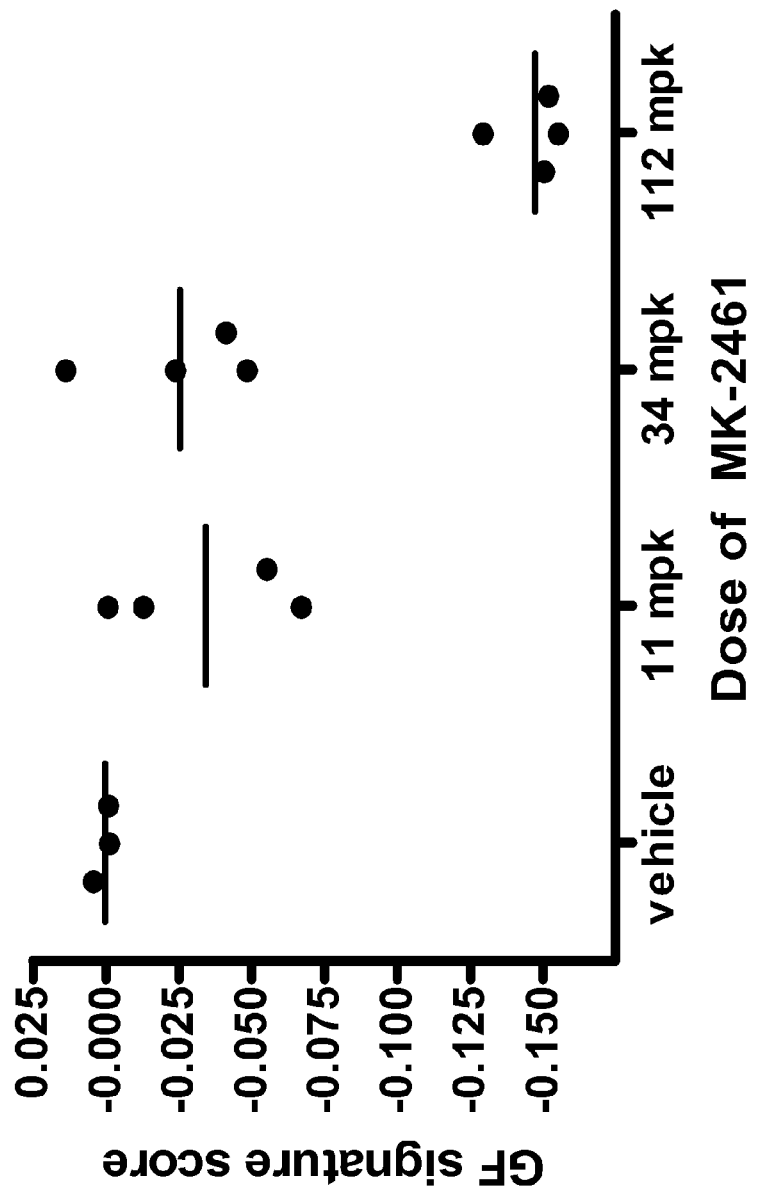

FIG. 13. Early efficacy experiments for cMET inhibitor MK-2461 in xenografts. Inhibition of the growth factor signaling pathway signature was only observed at 112 mpk. Of the different doses assayed, 112 mpk was the only dose that resulted in efficacy, suggesting that the growth factor signaling pathway signature could be used as an early readout of efficacy.

FIG. 14. Test for coherence and refining of Growth Factor Pathway Signaling Signature in the Mayo Breast dataset. A) This panel shows the results of coherency test: "up" and "down" arms of the signature significantly correlate within one arm and anti-correlate between the arms. B) Scatterplot of the "up" and "down" arms of the signature. The significance scores for "up" and "down" arms significantly anti-correlate.

Figure 15A:
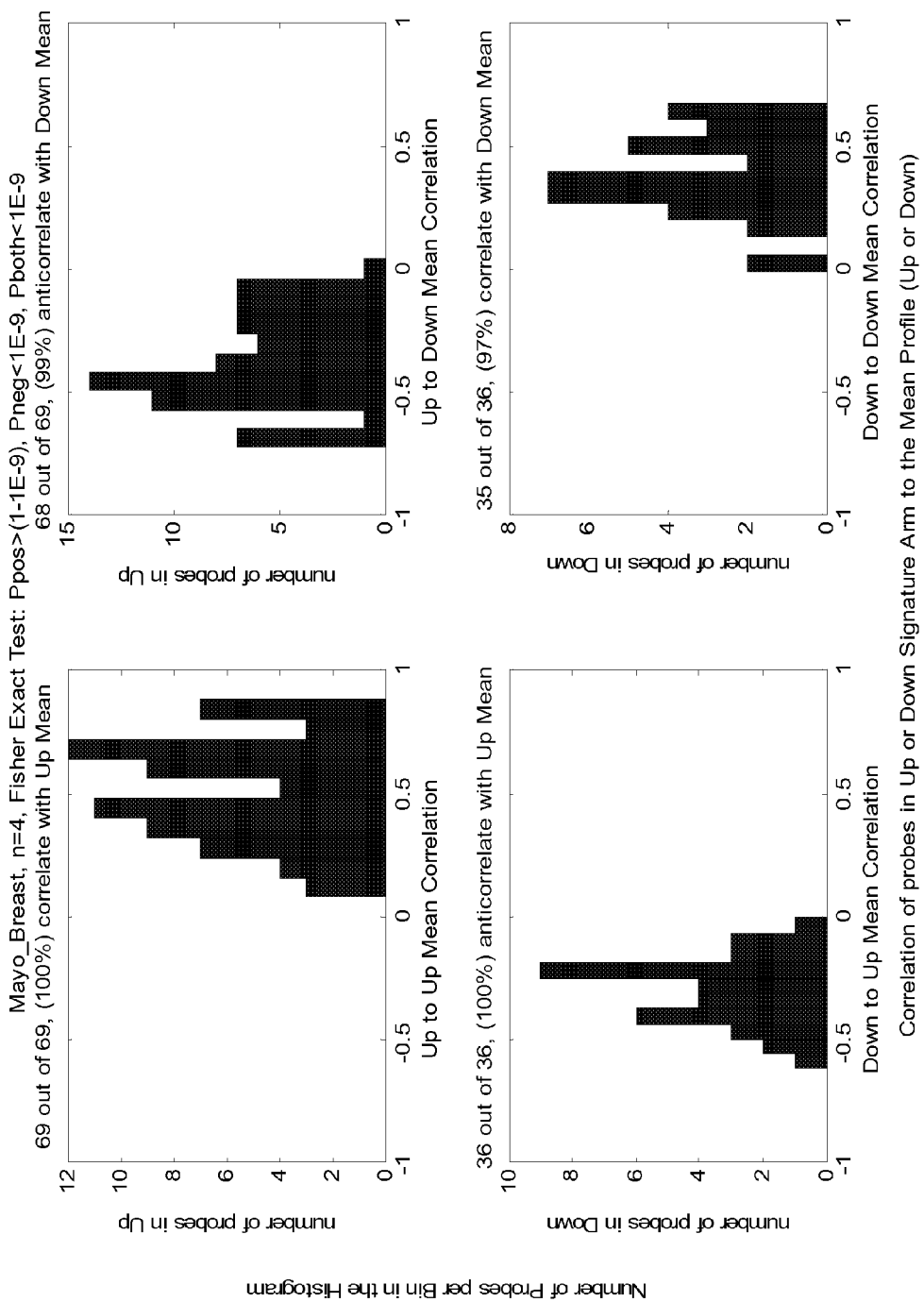
Figure 15B:
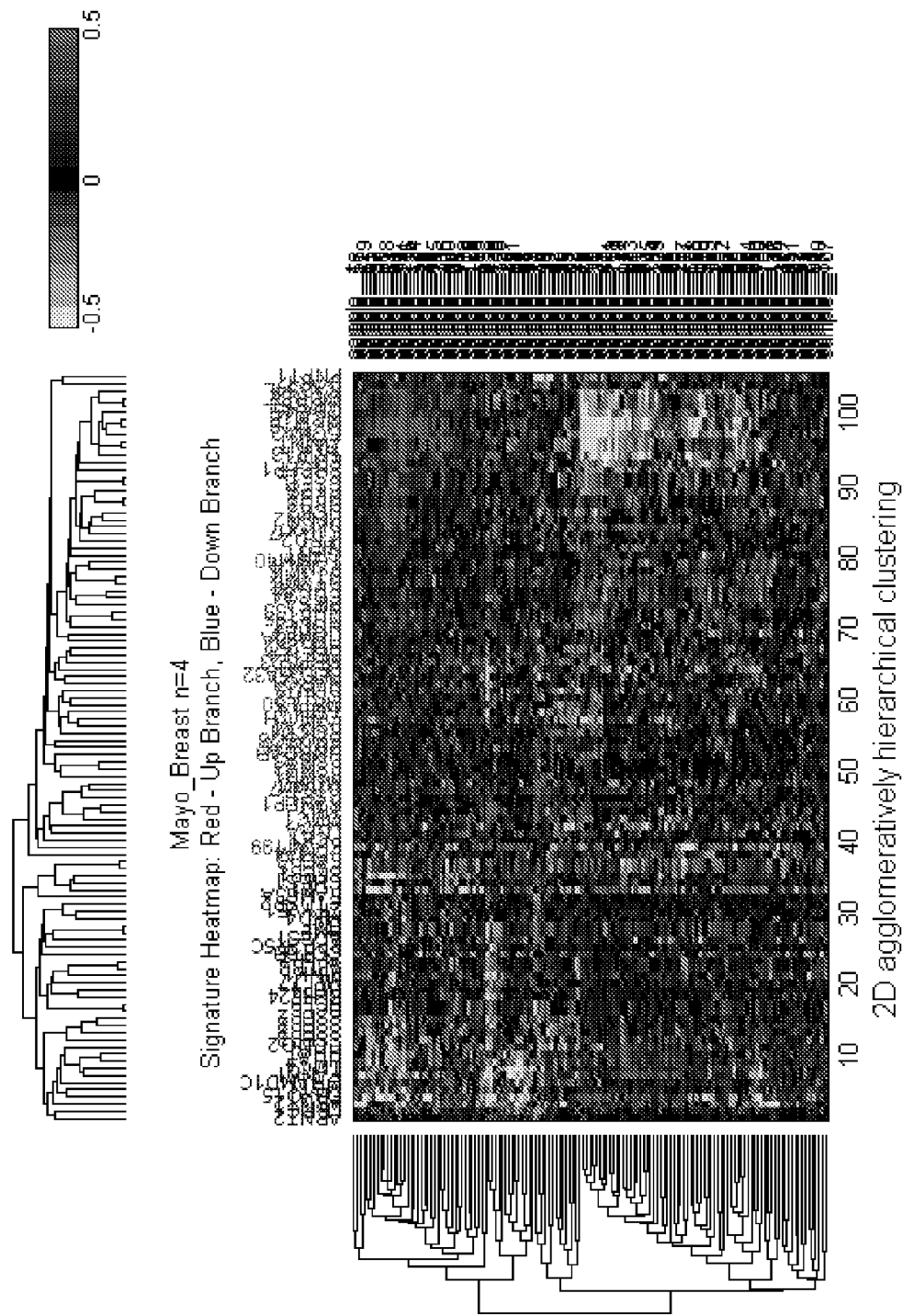
Figure 15C:
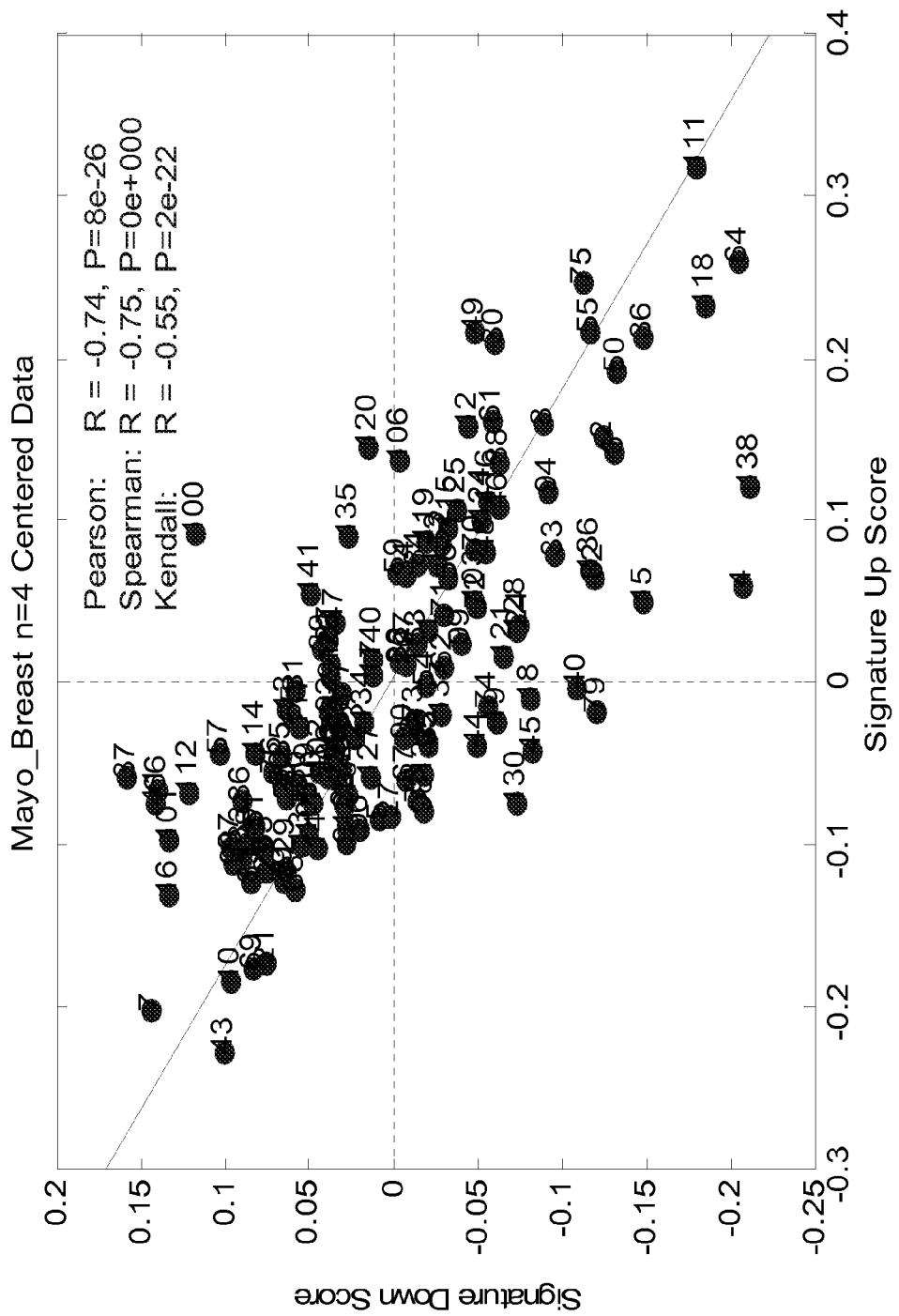

FIG. 15. Refining of the Growth Factor Pathway Signaling Signature in the Mayo Breast dataset. A) This panel shows the results of coherency test: the "up" and "down" arms of the signature significantly correlate within one arm and anti-correlate between arms after the signature was refined (removal of genes that showed incorrect sign of correlation/anti-correlation). B) Heatmap of the refined signature, showing separation of the up and down branches. C) Scatterplot of the "up" and "down" arms of the signature after refining. The "up" and "down" arms more significantly anti-correlate after refining.

Figure 16:
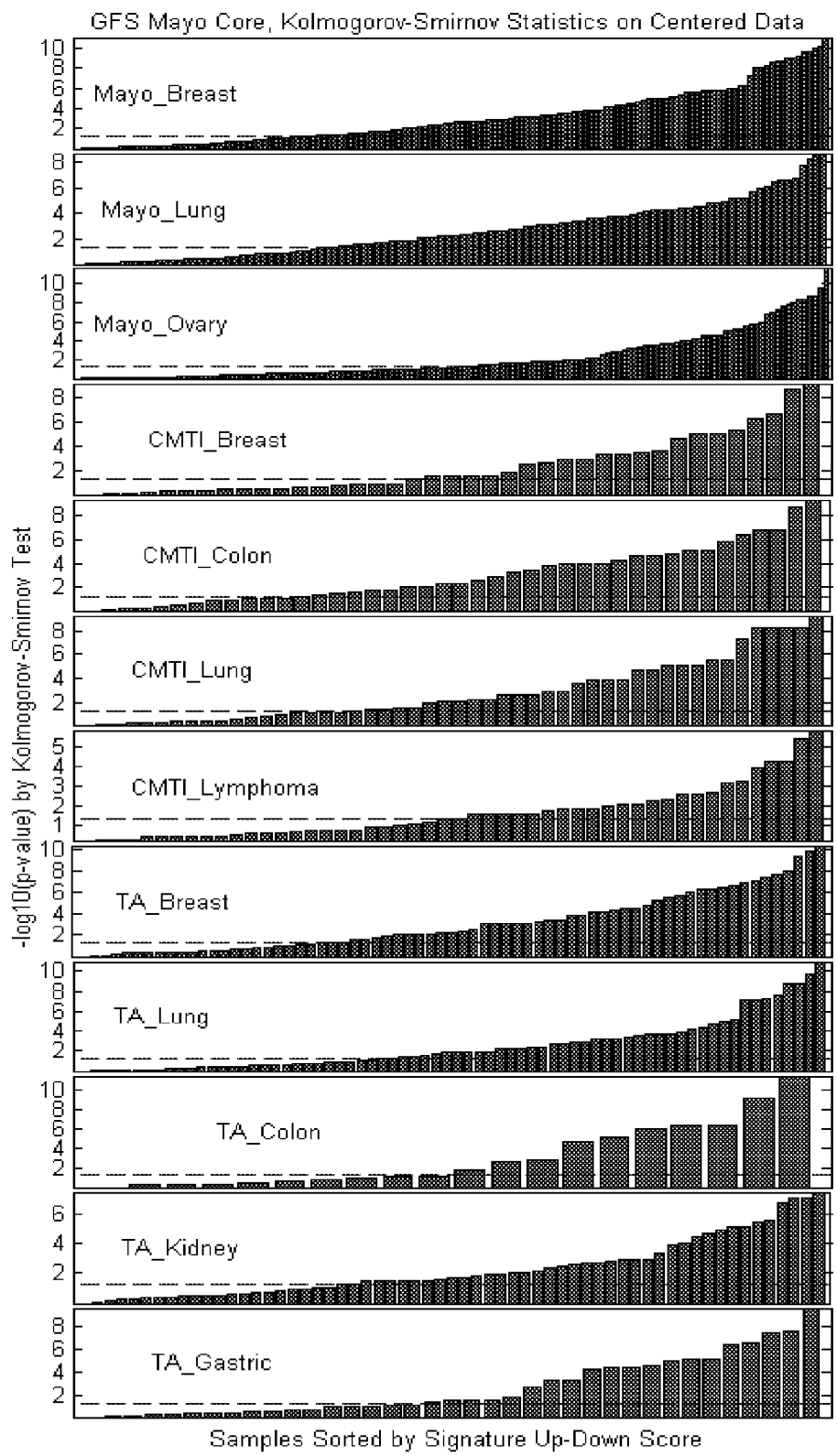

FIG. 16. Significance of the difference between "up" and "down" arms of the core FFPE refined signatures is tested using Kolmogorov-Smirnov test. Dotted line is drawn at $\alpha=0.05$ significance.

Figure 17:
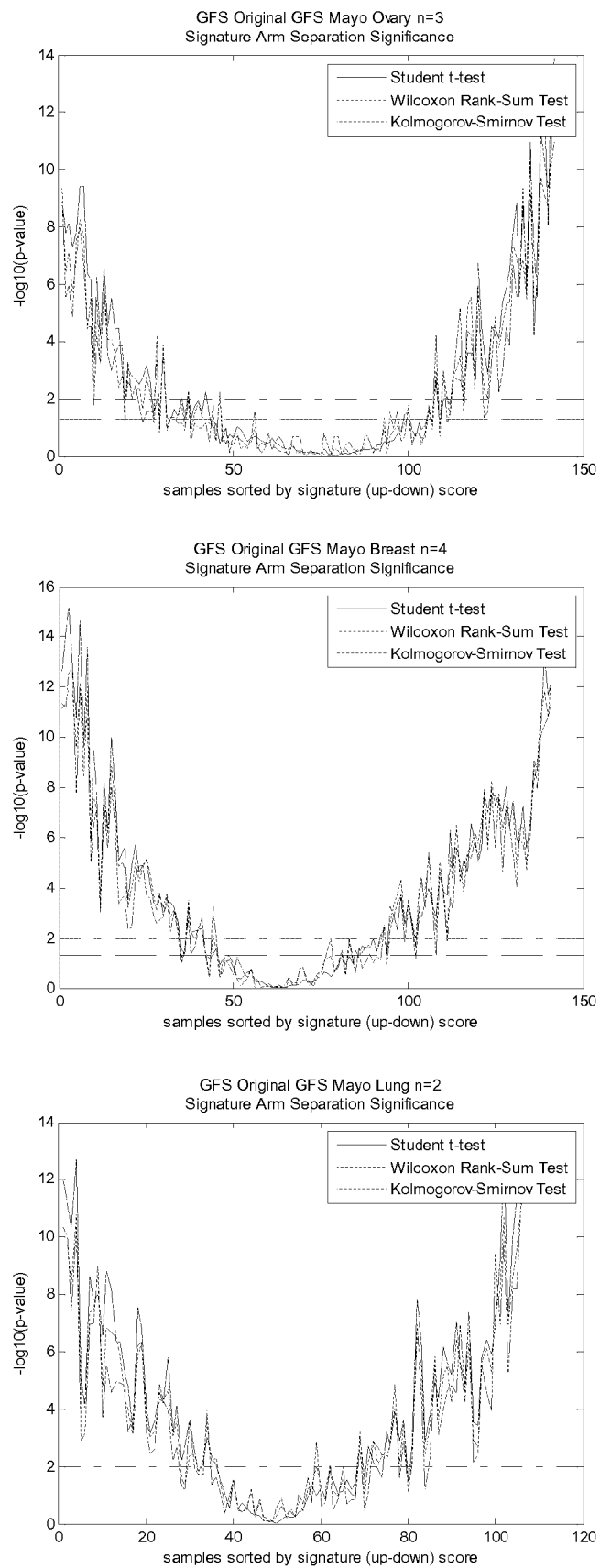

FIG. 17. Equivalence of the Kolmogorov-Smirnov, Student t-test, and Wilcoxon rank-sum test for detecting significance of the signature's up-down arm difference as tested on the Mayo FFPE datasets from breast, lung, and ovarian tumors.

Figure 18:
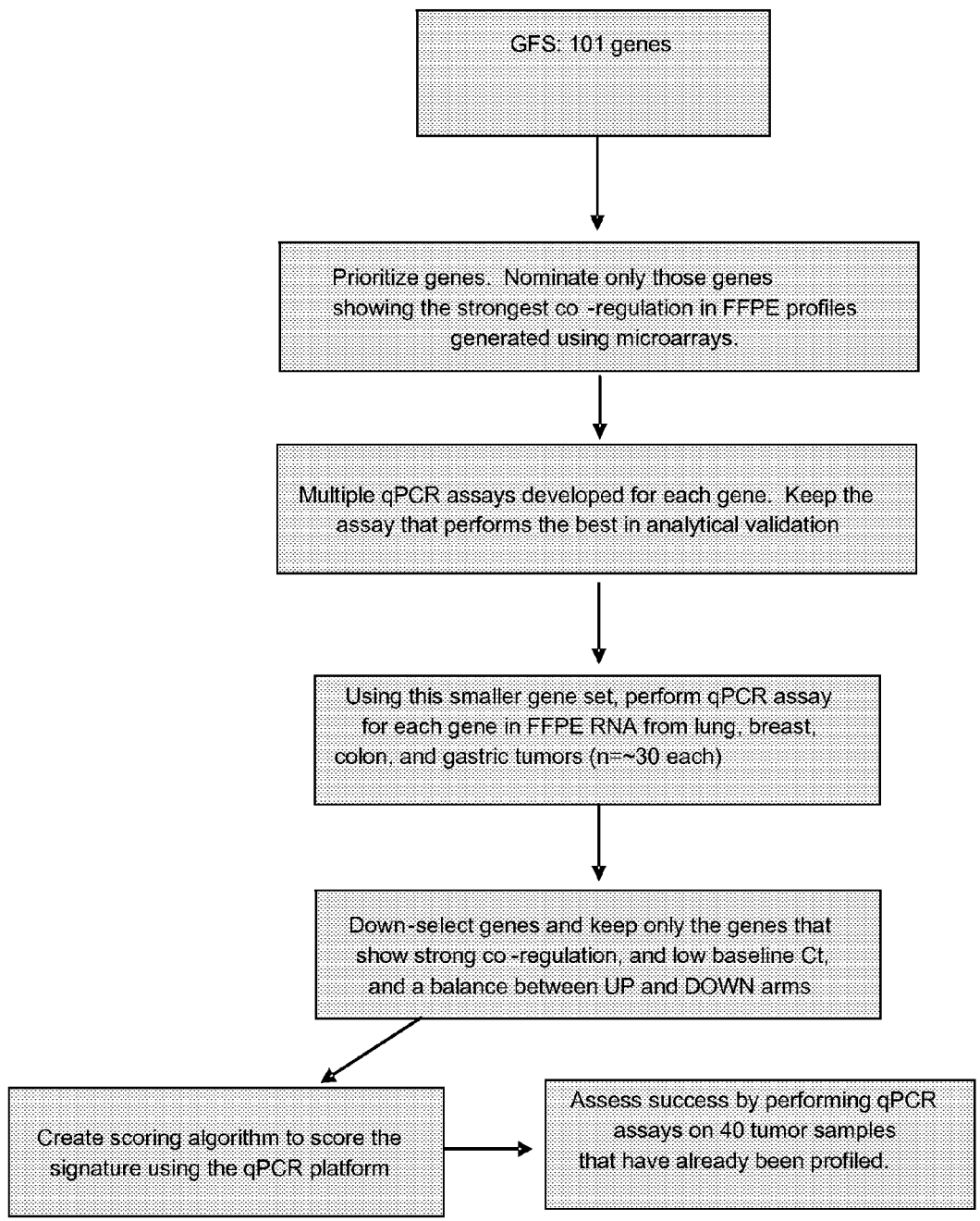

FIG. 18. Overall description of the strategy developed for signature translation.

Figure 19:
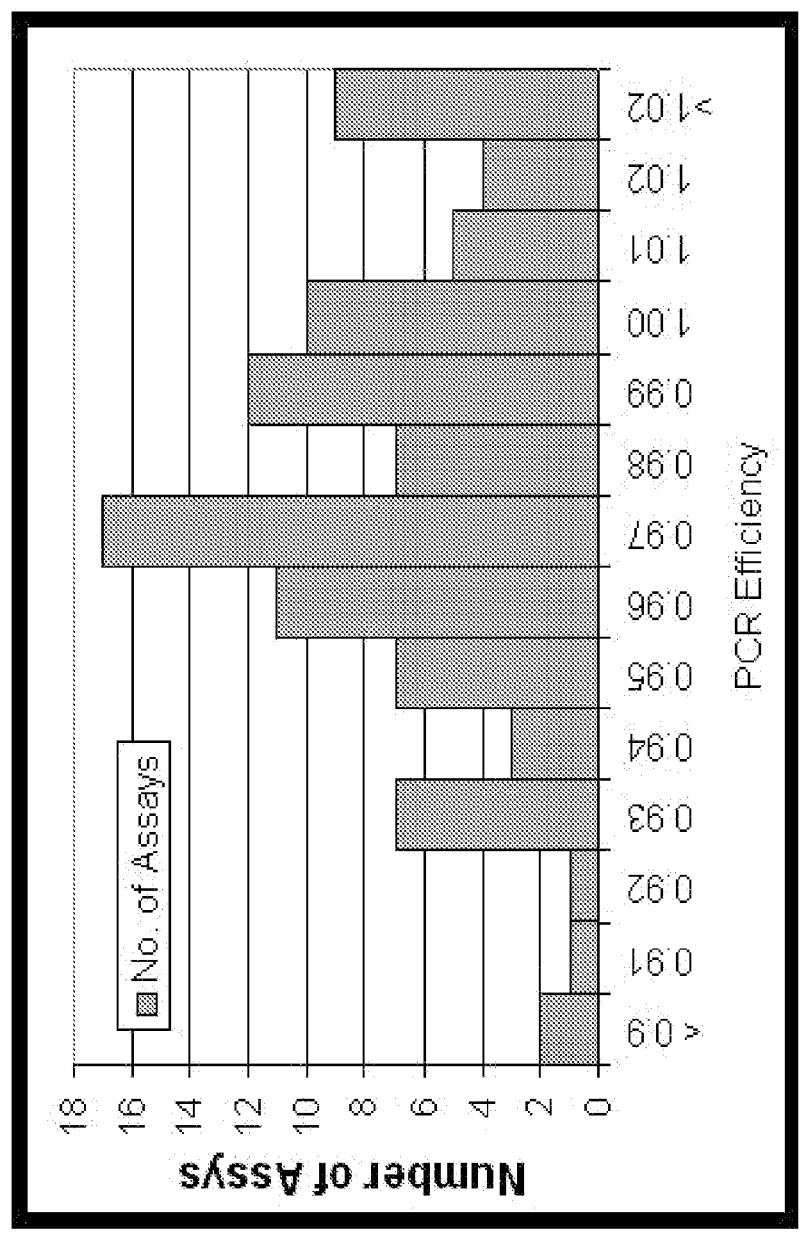

FIG. 19. Histogram of PCR efficiencies for each assay developed.

Figure 20:
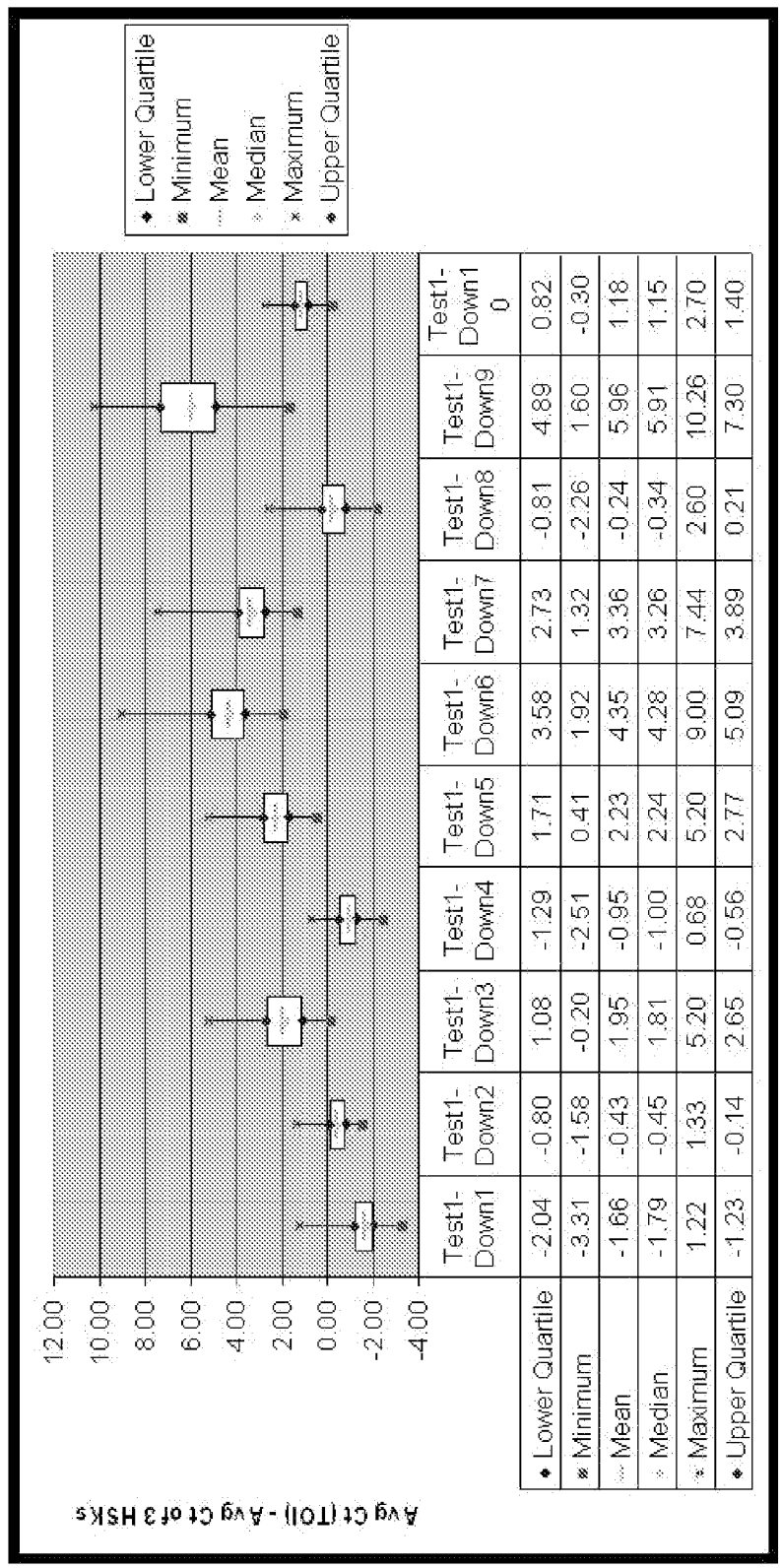

FIG. 20. Expression data for 10 randomly selected assays across 120 FFPE samples. Test 1=Growth Factor Signaling Pathway signature. DOWN indicates that the genes came from the DOWN arm of the signature. The dynamic range and summary statistics are shown for each assay.

Figure 21:
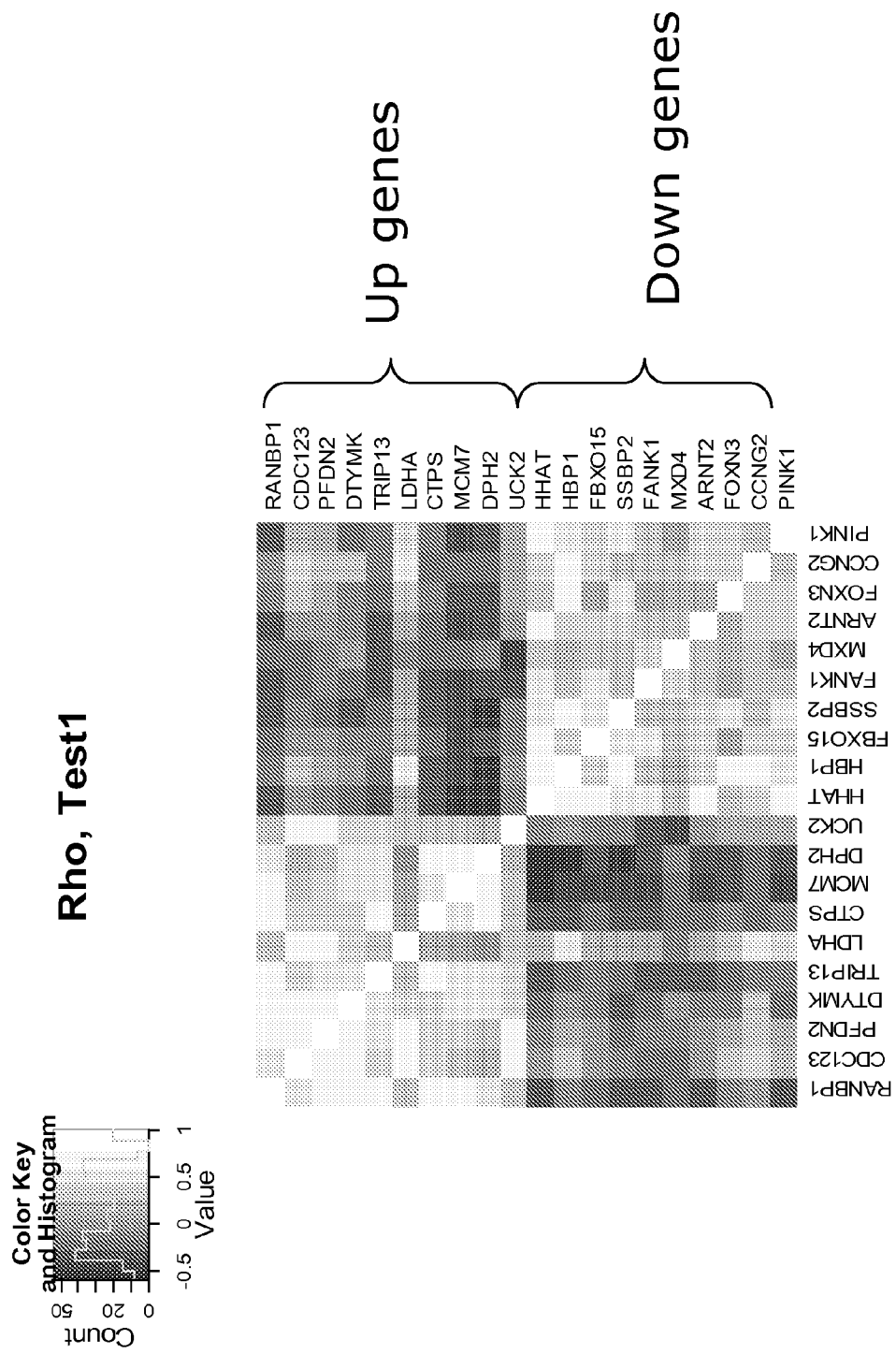

FIG. 21. Correlation matrix generated for the Growth Factor Signaling Pathway signature genes. This correlation matrix shows the correlation within the Up arm, within the Down arm, and the anti-correlation between the Up and Down arms across 120 FFPE tumor samples for a subset of the Growth Factor Signaling Pathway genes. Rho=Pearson correlation coefficient.

Figure 22:
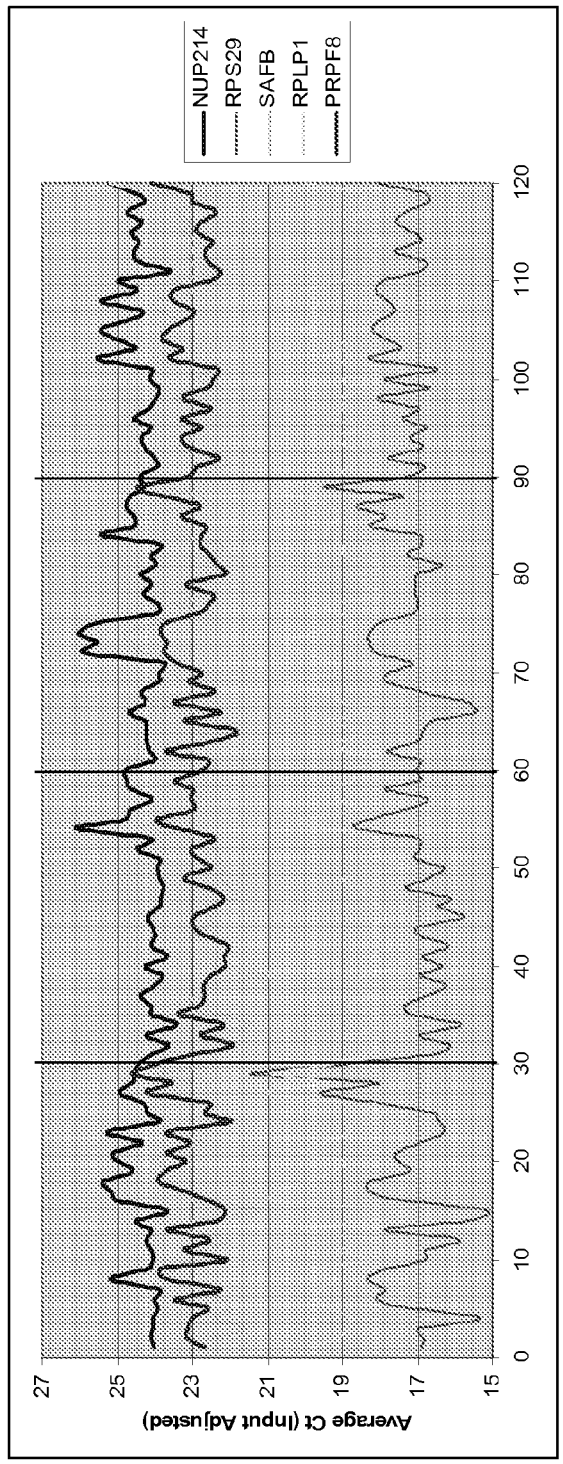

FIG. 22. Expression variation of five potential normalizer genes across 120 FFPE tumor samples. The top panel shows the average Ct value across triplicate measurements for each tumor sample. The lower panel shows the coefficient of variation for each gene in each tumor type. Genes with <3% Cv in any tumor type are highlighted. Due to the low variation and level of expression, NUP214, SAFB, and PRPF8 were chosen as our normalizers for the Growth Factor Signaling Pathway signature.

Figure 23:
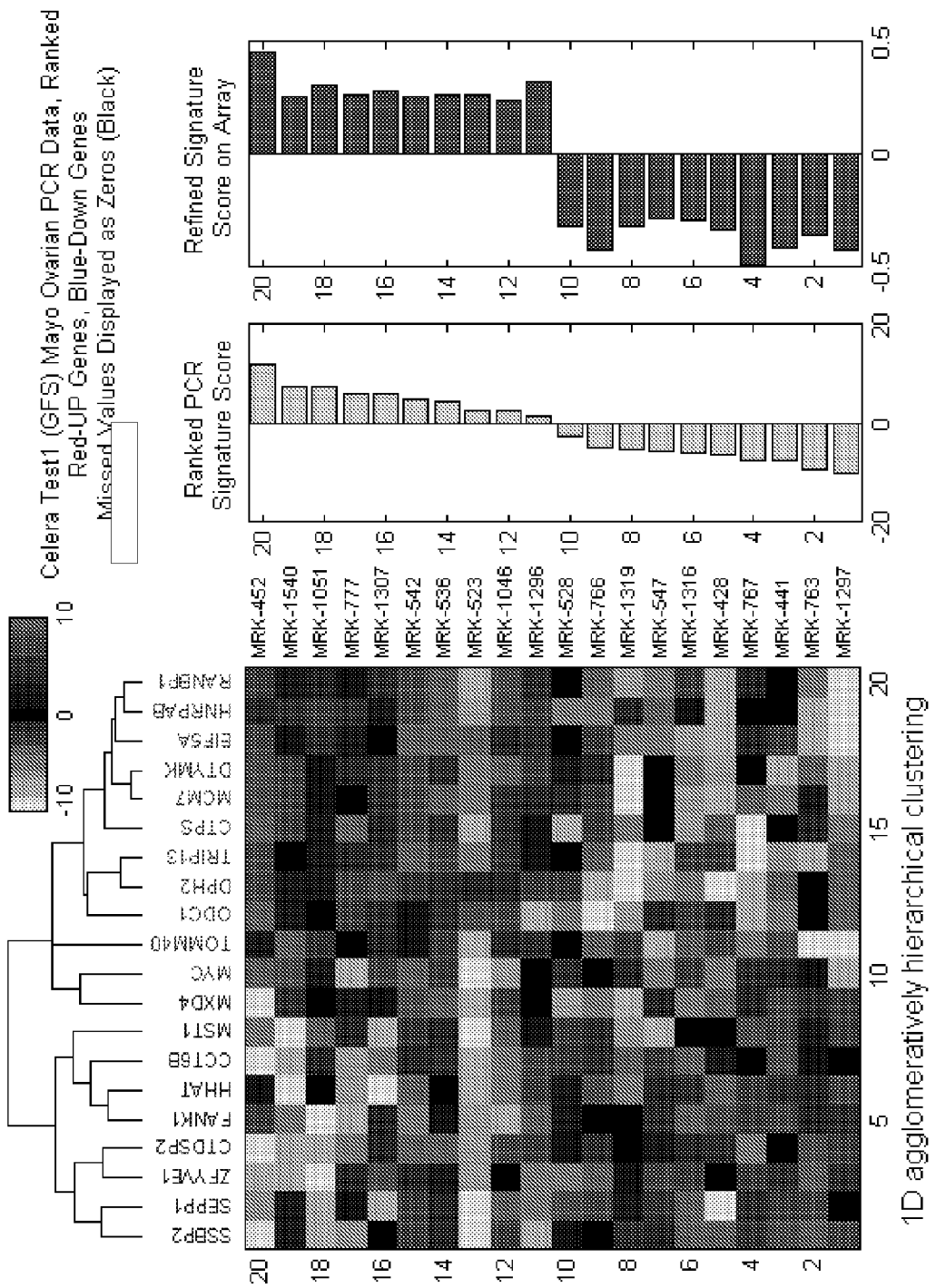

FIG. 23. Comparison of signature scores generated by microarray or qPCR in FFPE ovarian tumor samples.

Figure 24:
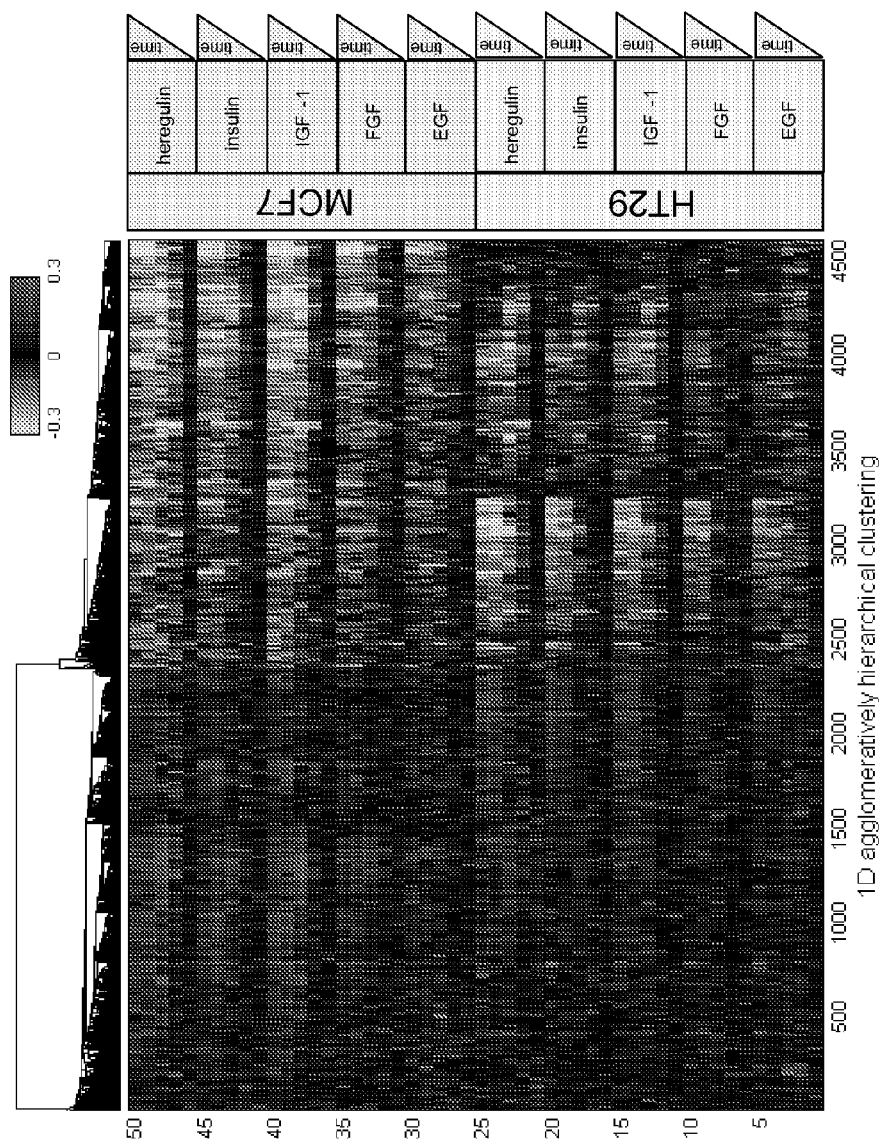

FIG. 24. Genes regulated by growth factor stimulation. MCF7 or HT29 cell lines were treated with EGF, IGF, Insulin, b-FGF, or heregulin for 0.5, 2, 6, 12 or 24 hr. Shown on the heatmap are approximately 4,500 genes differentially expressed between growth factor and vehicle treated samples with p<0.001. Genes in magenta were upregulated by growth factor stimulation, while genes in Cyan were downregulated by growth factor stimulation. The color bar represents the log(10) ratio for changes relative to vehicle.

Figure 25A:
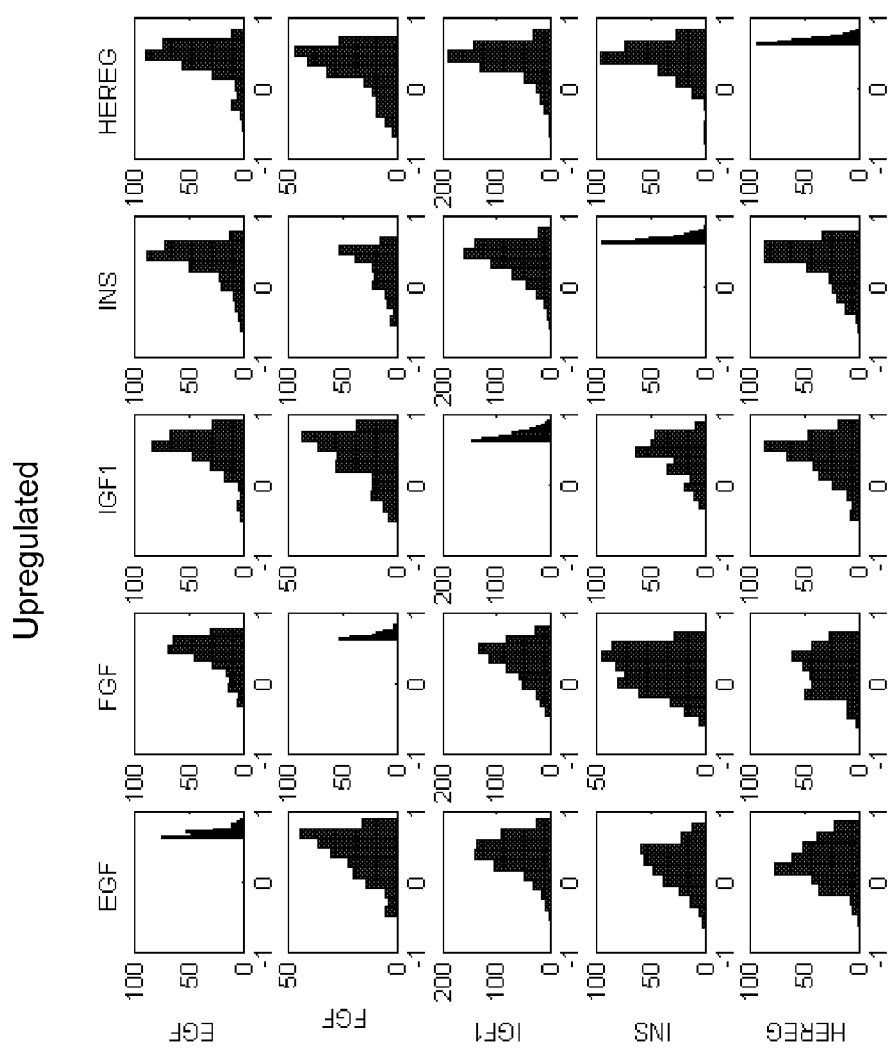
Figure 25B:
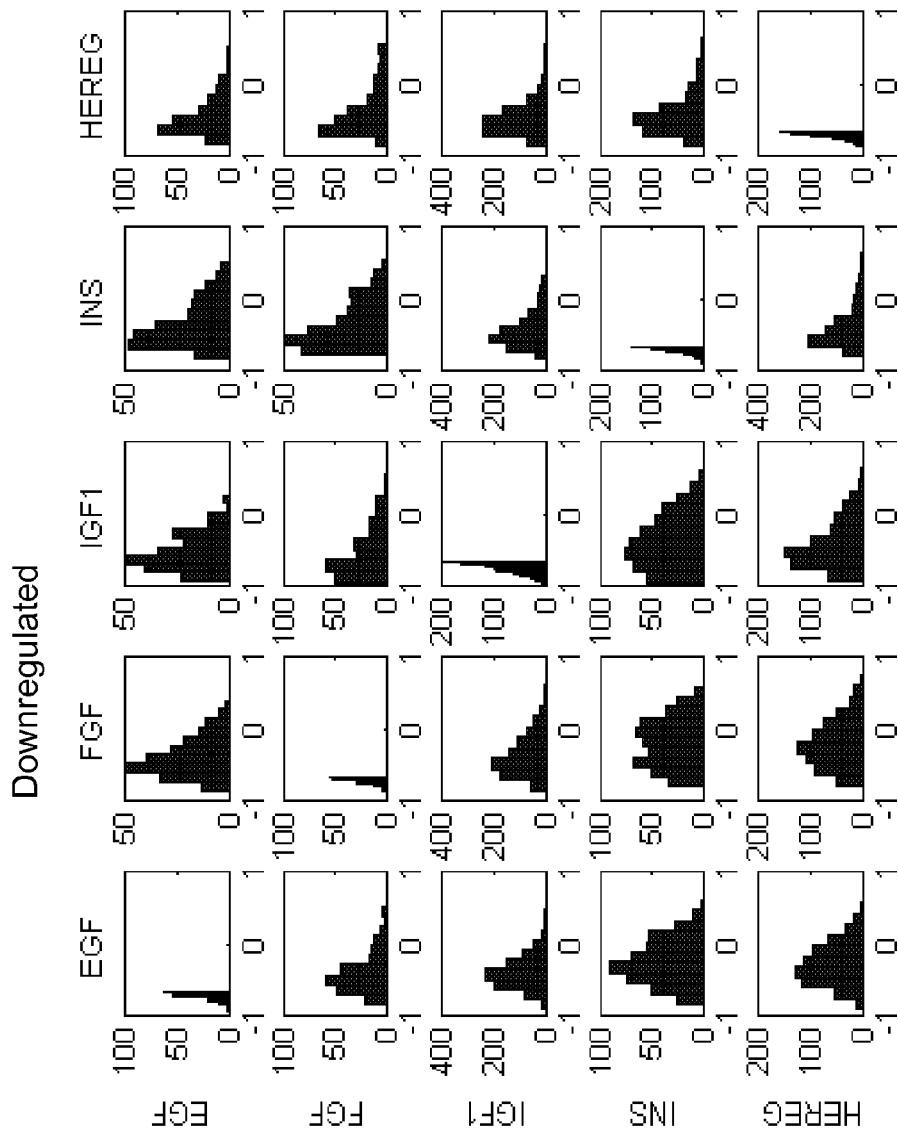

FIG. 25. EGF, FGF, IGF, Insulin, or Heregulin induce similar gene expression changes. A) The changes induced by each of the growth factors in MCF7 and HT29 human cancer cell lines at 0.5, 2, 6, 12, or 24 hr post-dose were correlated to an upregulated ramp pattern. The Y-axis represents the number of genes and the X-axis represents the log(10) ratio for expression relative to vehicle. The first column shows only the genes that are upregulated by EGF, second-FGF, third-IGF1, fourth-Insulin, fifth-Heregulin. The first row shows how the genes, filtered according to their column behave when stimulated by EGF, second-FGF, third-IGF1, fourth-Insulin, fifth-Heregulin. Genes that are upregulated by one growth factor are also upregulated by other growth factors. B) Genes that are downregulated by one growth factor are also downregulated by other growth factors.

Figure 26:
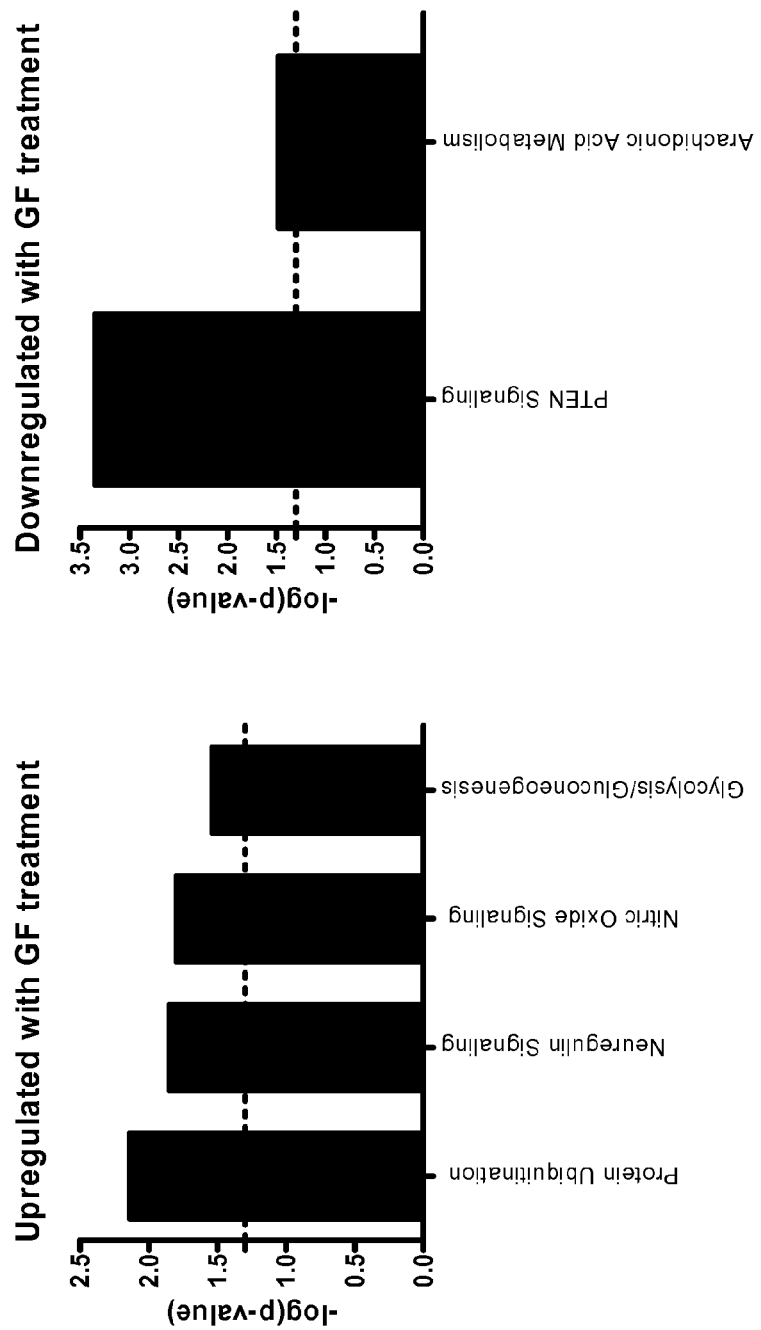

FIG. 26. Canonical pathways enriched in the growth factor signature assessed using Ingenuity Pathway Analysis. Pathways significantly enriched (p<0.05) within genes up- or down-regulated by growth factor treatment are shown. The Y-axis shows the negative log(10) p-value for enrichment. Pathways are shown along the X-axis. The dotted line represents p=0.05.

Figure 27:
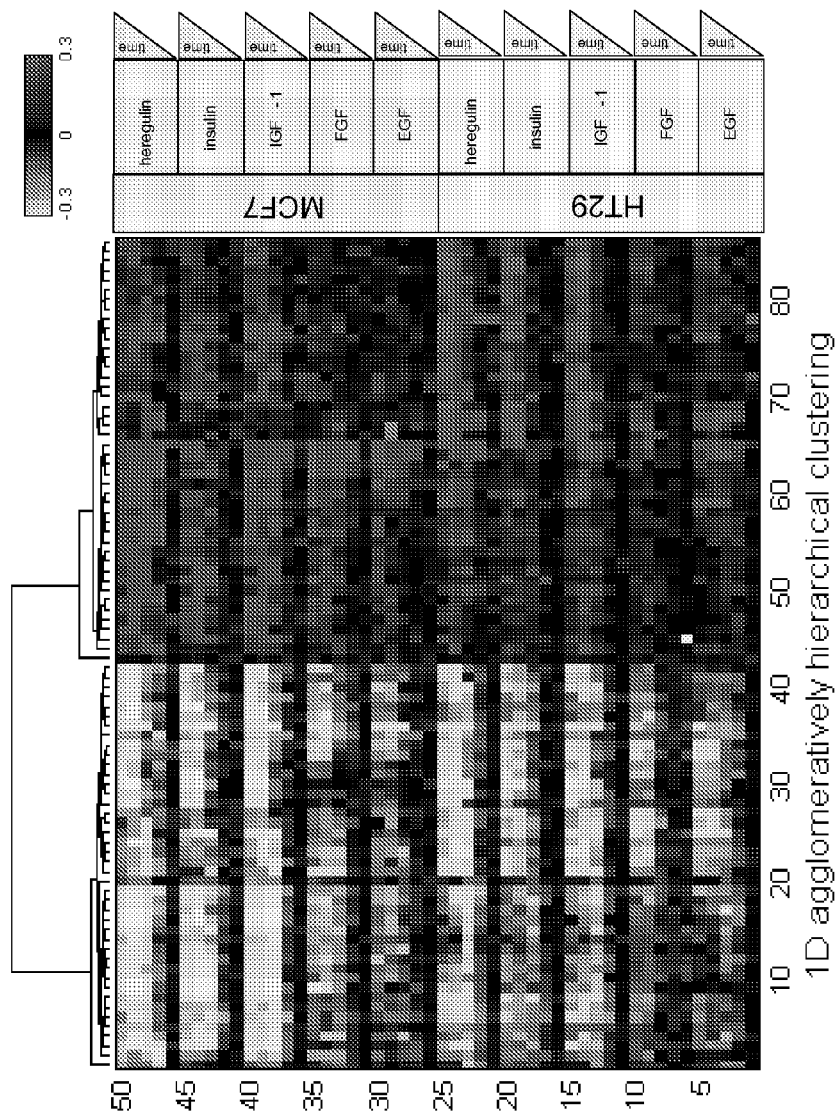

FIG. 27. The growth factor signature is robustly regulated in both HT-29 and MCF-7 cell lines. Genes in magenta were upregulated by growth factor stimulation, while genes in Cyan were downregulated by growth factor stimulation. The color bar represents the log(10) ratio for changes relative to vehicle.

Figure 28:
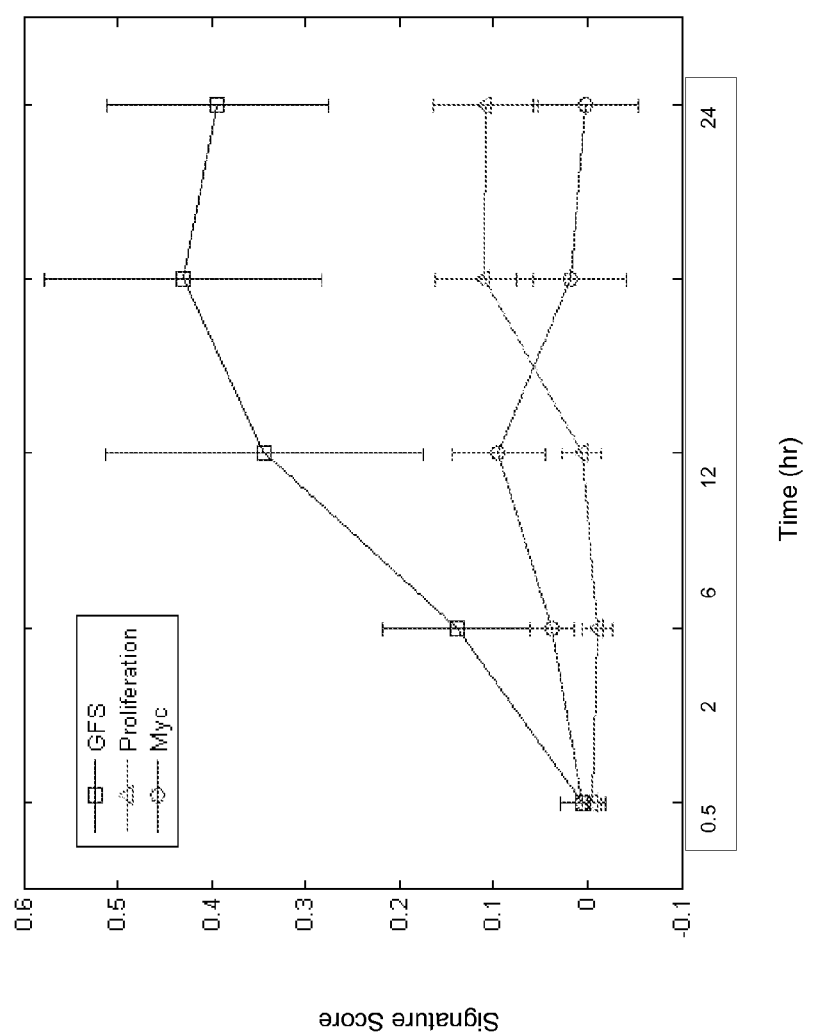

FIG. 28. The temporal pattern of activation of the c-MYC, proliferation, and growth factor signatures. Each signature score was calculated and averaged across cell lines and growth factors. The Y-axis represents the signature score, and the X-axis represents the time point after growth factor addition. Error bars represent standard deviation. In contrast to the c-MYC and proliferation signatures, the growth factor signature is induced at 2 hours, and remains significantly induced through 24 hours.

FIG. 29. Negative feedback induced by growth factors. The data presented represents the effect of each growth factor on the mRNA expression of (A) EGFR, (B) ERBB3, (C) INSR, or (D) a recently published signature of aberrant PTEN activity. The Y-axes represent the log(10) ratio of expression relative to vehicle. The left half of each panel shows data for MCF7 cells, and the right half shows data for HT29 cells. The X-axes represent the time point after growth factor addition.

Figure 30:
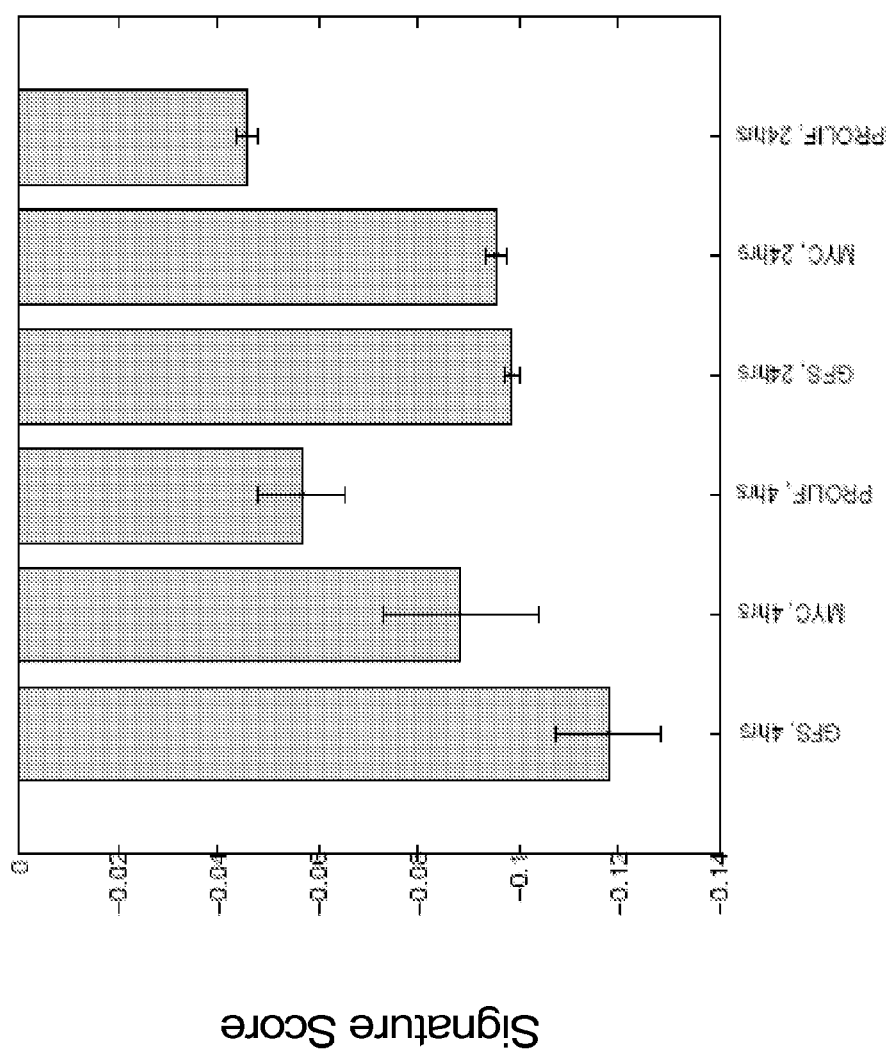

FIG. 30. A small molecule inhibitor of AKT1 caused downregulation of the growth factor signature. A small molecule inhibitor of AKT1 was added to LoVo cell lines for 4 or 24 hours. Data were expressed as the log(10) ratio relative to time-matched vehicle.

FIG. 31. Distribution of (A) growth factor signature, (B) PTEN mRNA, (C) aberrant PTEN signature, and (D) ERBB3 mRNA expression across breast cancer subtypes. In each panel, the Y-axis represents signature score (A and C) or log(10) expression of a single gene (B and D) in mean-centered data. The X-axis represents the log(10) gene expression of ERBB2 in mean-centered data. Dotted lines on the X and Y axes represent the mean of all breast tumor samples. Therefore, samples with ERBB2 expression>0 may be considered ERBB2 high, and samples with ERBB2 expression<0 may be considered ERBB2 low. ER status is based on expression of the ESR1 gene, and the ER status call was performed as previously described (Van de Vijver et al., 2002, N. Engl. J. Med. 347:1999-2009). Open circles represent ER positive tumors and filled squares represent ER negative tumors.

Figure 32:
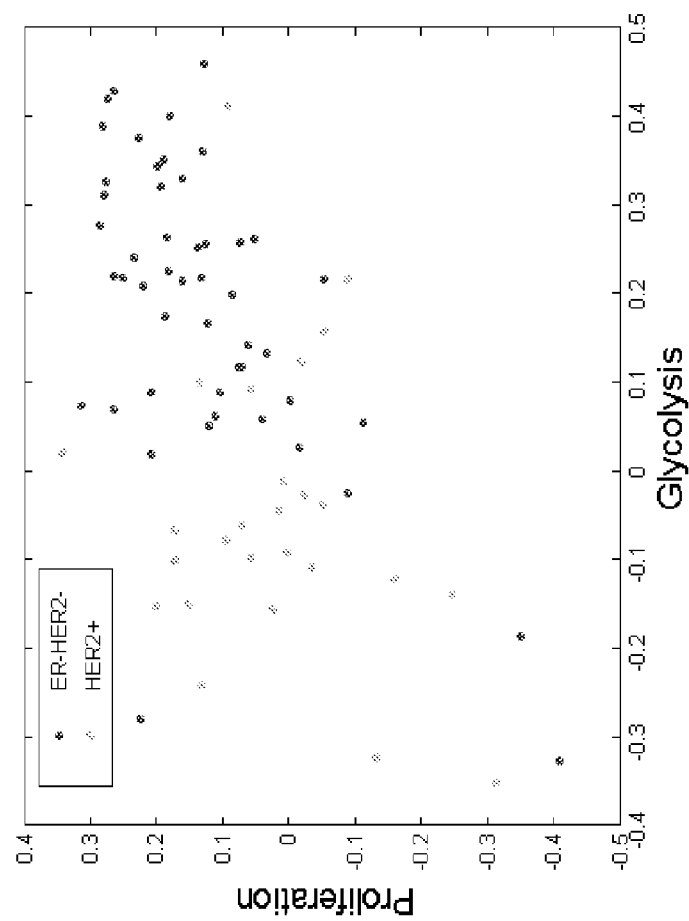

FIG. 32. Proliferation and glycolysis signatures in breast cancer subsets. The Y-axis represents the proliferation signature score and the X-axis represents the glycolysis signature score. Light gray circles represent HER2+ breast tumors (defined as breast tumors with ERBB2 mRNA expression greater than the mean in Van de Vijver et al., 2002, N. Engl. J. Med. 347:1999-2009). Dark gray circles represent "triple negative" breast tumors (defined as ER and PR negative breast tumors with ERBB2 mRNA expression below the mean in Van de Vijver et al., supra.

Figure 33:
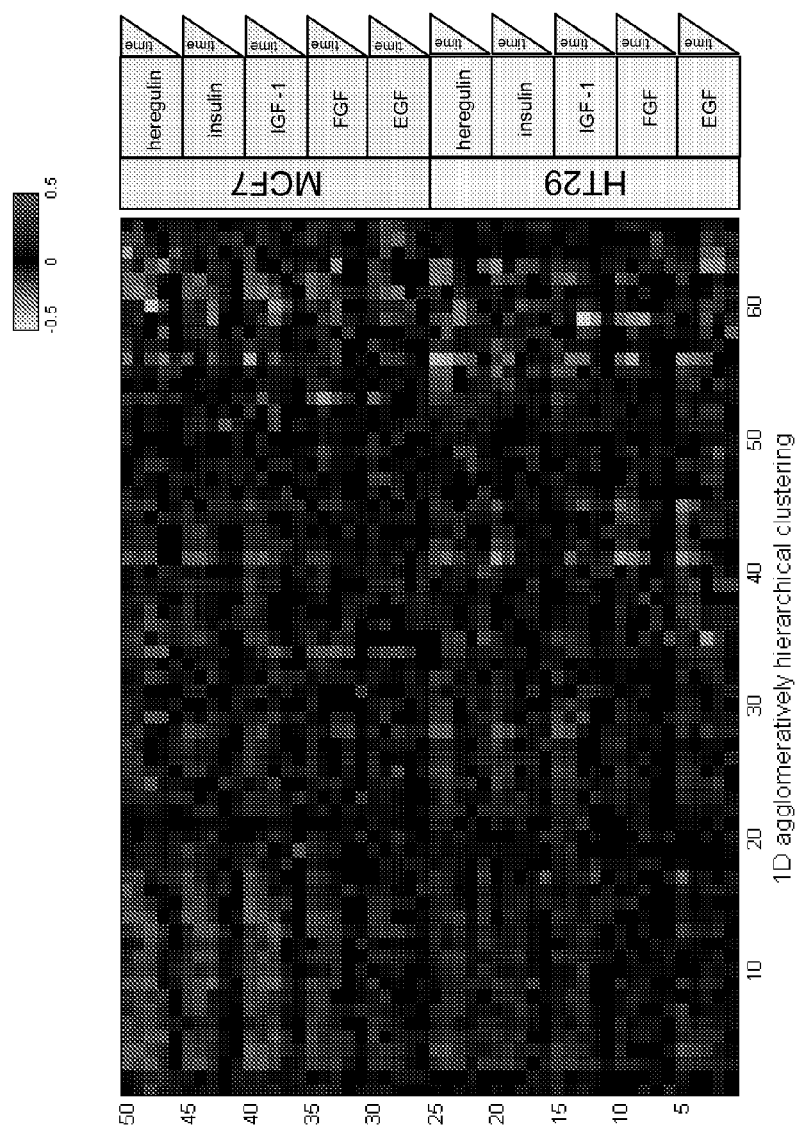

FIG. 33. The glycolysis signature is upregulated by growth factor treatment. Only genes whose expression is positively correlated with glycolysis are shown. Genes in magenta were upregulated by growth factor stimulation, while genes in Cyan were downregulated by growth factor stimulation. The color bar represents the log(10) ratio for changes relative to vehicle.

Figure 34:
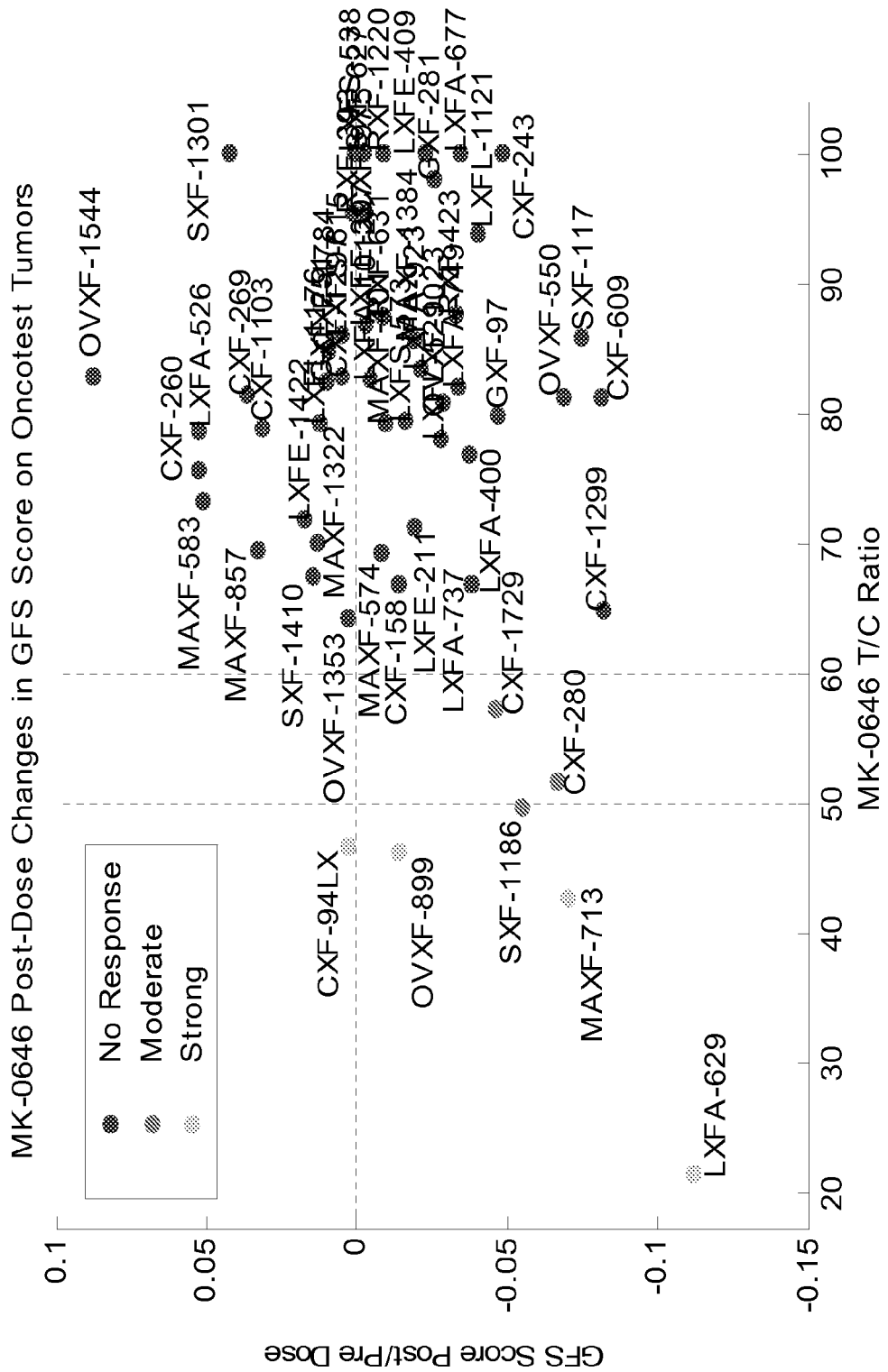

FIG. 34. Magnitude of growth factor pathway signature change vs. tumor xenograft growth inhibition by IGF1R compound MK-0646

3. DETAILED DESCRIPTION OF THE INVENTION

This section presents a detailed description of the many different aspects and embodiments that are representative of the inventions disclosed herein. This description is by way of several exemplary illustrations, of varying detail and specificity. Other features and advantages of these embodiments are apparent from the additional descriptions provided herein, including the different examples. The provided examples illustrate different components and methodology useful in practicing various embodiments of the invention. The examples are not intended to limit the claimed invention. Based on the present disclosure the ordinary skilled artisan can identify and employ other components and methodology useful for practicing the present invention.

3.1 Introduction

Various embodiments of the invention relate to sets of genetic biomarkers whose expression patterns correlate with an important characteristic of cancer cells, i.e., deregulation of the growth factor (PI3K) signaling pathway. In some embodiments, these sets of biomarkers may be split into two opposing "arms" (see Tables 5a and 5b; Table 9; Table 11)—the "up" arm, which are the genes that are upregulated, and the "down" arm, which are the genes that are downregulated, as signaling through the growth factor (PI3K) pathway increases. More specifically, some aspects of the invention provide for sets of genetic biomarkers whose expression correlates with the regulation status of the growth factor signaling pathway of a tumor cell sample of a patient, and which can be used to classify tumors with deregulated growth factor signaling pathway from tumors with regulated growth factor signaling pathway. Growth factor signaling pathway regulation status is a useful indicator of the likelihood that a patient will respond to certain therapies, such as inhibitors of the growth factor signaling pathway. Such therapies include, but are not limited to: PI3K inhibitors LY249002, wortmannin, and PX-866; AKT inhibitors 17-AAG, PX316, miltefosine, and perifosin; mTOR inhibitors rapamycin, CCI1779, deforolimus Gand Rad001 (reviewed in Henson and Gibson 2006, Cellular Signalling 18:2089-2097; Hennessy et al., 2005, Nat. Rev. Drug Disc. 4:988-1004), and IGF1R monoclonal antibody MK-0646 (U.S. Pat. No. 7,241,444). Also, tumors which have a deregulated growth factor signaling pathway are much less responsive to mitotic inhibitor type therapies (for example, taxol, KSP inhibitors, tubulin inhibitors, kinesin inhibitors, kinase inhibitors). In one aspect of the invention, methods are provided for use of these biomarkers to distinguish between patient groups that will likely respond to inhibitors of the growth factor signaling pathway (predicted responders) and patient groups that will not likely respond to inhibitors of the growth factor signaling pathway and to determine general courses of treatment (predicted non-responders). Another aspect of the invention relates to biomarkers whose expression correlates with a pharmacodynamic effect of a therapeutic agent on the growth factor signaling pathway in subject with cancer. In yet other aspects of the invention, methods are provided for use of these biomarkers to measure the pharmacodynamic effect of a therapeutic agent on the growth factor signaling pathway in a subject with cancer and the use of these biomarkers to rank the efficacy of therapeutic agents to modulate the growth factor signaling pathway. Microarrays comprising these biomarkers are also provided, as well as methods of constructing such microarrays. Each of the biomarkers correspond to a gene in the human genome, i.e., such biomarker is identifiable as all or a portion of a gene. Finally, because each of the above biomarkers correlate with cancer-related conditions, the biomarkers, or the proteins they encode, are likely to be targets for drugs against cancer.

Other embodiments of the invention relate to a set of genetic biomarkers whose expression patterns correlate with another important characteristic of cancer cells, i.e., increased glycolysis (Table 13). More specifically, some aspects of the invention provide for a set of genetic biomarkers whose expression correlates with glycolysis pathway activity, and which can be used to classify tumors with increased glycolysis pathway activity from tumors or normal cell samples without increased glycolysis pathway activity. Increased glycolysis pathway activity is a nearly universal property of primary and metastatic cancers and may be used to classify tumors from normal cell samples and may be a useful indicator of the likelihood a patient will respond to certain therapies, such as inhibitors of the glycolysis pathway. Such therapies include, but are not limited to: hexokinase inhibitors lonidamine, 3-bromopyruvate; glucose analog 2-deoxyglucose; imatinib; phosphofructokinase inhibitors; pyruvate kinase inhibitors; pyruvate dehydrogenase kinase inhibitors; oxythiamine; genistein; 5-thioglucose; mannoheptulose; α-chlorohydrin; ornidazole; glufosfamide; arsenic compounds; oxamate; iodoacetate; bisphosphonates; tubercidin; and $Na^+/K^+$-ATPase pump inhibitors (reviewed Lopez-Lazaro, 2008, Anti-Cancer Agents in Medicinal Chemistry 8:305-312). Glycolysis pathway biomarkers may also be a useful indicator of the likelihood a patient will respond to inhibitors of the growth factor signaling pathway. In one aspect of the invention, methods are provided for use of these biomarkers to distinguish between patient groups that will likely respond to inhibitors of the glycolytic pathway (predicted responders) and patient groups that will not likely respond to inhibitors of the glycolytic pathway and to determine general courses of treatment (predicted non-responders). Another aspect of the invention relates to biomarkers whose expression correlates with a pharmacodynamic effect of a therapeutic agent on the glycolytic pathway in a subject with cancer. In yet other aspects of the invention, methods are provided for the use of these biomarkers to measure the pharmacodynamic effect of a therapeutic agent on the glycolytic pathway in a subject with cancer and the use of these biomarkers to rank the efficacy of therapeutic agents to modulate the glycolytic pathway. Microarrays comprising these biomarkers are also provided, as well as methods of constructing such microarrays. Each of the biomarkers correspond to a gene in the human genome, i.e., such biomarker is identifiable as all or a portion of a gene. Finally, because each of the above biomarkers correlate with cancer-related conditions, the biomarkers, or the proteins they encode, are likely to be targets for drugs against cancer.

3.2 Definitions

Unless defined otherwise, all technical and scientific terms used herein have the same meaning as commonly understood to one of ordinary skill in the art to which this invention belongs.

As used herein, oligonucleotide sequences that are complementary to one or more of the genes described herein, refers to oligonucleotides that are capable of hybridizing under stringent conditions to at least part of the nucleotide sequence of said genes. Such hybridizable oligonucleotides will typically exhibit at least about 75% sequence identity at the nucleotide level to said genes, preferably about 80% or 85% sequence identity or more preferably about 90% or 95% or more sequence identity to said genes.

"Bind(s) substantially" refers to complementary hybridization between a probe nucleic acid and a target nucleic acid and embraces minor mismatches that can be accommodated by reducing the stringency of the hybridization media to achieve the desired detection of the target polynucleotide sequence.

The phrase "hybridizing specifically to" refers to the binding, duplexing or hybridizing of a molecule substantially to or only to a particular nucleotide sequence or sequences under stringent conditions when that sequence is present in a complex mixture (e.g., total cellular) DNA or RNA.

"Biomarker" means any gene, protein, or an EST derived from that gene, the expression or level of which changes between certain conditions. Where the expression of the gene correlates with a certain condition, the gene is a biomarker for that condition.

"Biomarker-derived polynucleotides" means the RNA transcribed from a biomarker gene, any cDNA or cRNA produced therefrom, and any nucleic acid derived therefrom, such as synthetic nucleic acid having a sequence derived from the gene corresponding to the biomarker gene.

A gene marker is "informative" for a condition, phenotype, genotype or clinical characteristic if the expression of the gene marker is correlated or anti-correlated with the condition, phenotype, genotype or clinical characteristic to a greater degree than would be expected by chance.

As used herein, the term "gene" has its meaning as understood in the art. However, it will be appreciated by those of ordinary skill in the art that the term "gene" may include gene regulatory sequences (e.g., promoters, enhancers, etc.) and/or intron sequences. It will further be appreciated that definitions of gene include references to nucleic acids that do not encode proteins but rather encode functional RNA molecules such as tRNAs. For clarity, the term gene generally refers to a portion of a nucleic acid that encodes a protein; the term may optionally encompass regulatory sequences. This definition is not intended to exclude application of the term "gene" to non-protein coding expression units but rather to clarify that, in most cases, the term as used in this document refers to a protein coding nucleic acid. In some cases, the gene includes regulatory sequences involved in transcription, or message production or composition. In other embodiments, the gene comprises transcribed sequences that encode for a protein, polypeptide or peptide. In keeping with the terminology described herein, an "isolated gene" may comprise transcribed nucleic acid(s), regulatory sequences, coding sequences, or the like, isolated substantially away from other such sequences, such as other naturally occurring genes, regulatory sequences, polypeptide or peptide encoding sequences, etc. In this respect, the term "gene" is used for simplicity to refer to a nucleic acid comprising a nucleotide sequence that is transcribed, and the complement thereof. In particular embodiments, the transcribed nucleotide sequence comprises at least one functional protein, polypeptide and/or peptide encoding unit. As will be understood by those in the art, this functional term "gene" includes both genomic sequences, RNA or cDNA sequences, or smaller engineered nucleic acid segments, including nucleic acid segments of a non-transcribed part of a gene, including but not limited to the non-transcribed promoter or enhancer regions of a gene. Smaller engineered gene nucleic acid segments may express, or may be adapted to express using nucleic acid manipulation technology, proteins, polypeptides, domains, peptides, fusion proteins, mutants and/or such like. The sequences which are located 5' of the coding region and which are present on the mRNA are referred to as 5' untranslated sequences ("5'UTR"). The sequences which are located 3' or downstream of the coding region and which are present on the mRNA are referred to as 3' untranslated sequences, or ("3'UTR").

"Mitotic inhibitor" refers to a drug or agent which inhibits mitosis. Mitotic inhibitors may be divided into two classes. One class includes agents which modulate microtubule dynamics. These agents may bind reversibly to tubulin and prevent microtubule assembly and disassembly. The second class includes non-tubulin binding agents, which regulate mitotic events vicariously by interacting with specific intracellular targets, such as mitotic kinesins, kinases, separase, etc. Examples of mitotic inhibitors are well known in the art and include, but are not limited to: tubulin inhibitors (such as taxanes, epothilones, vinca alkaloids, combretastatin, eleutherobines); kinesin inhibitors (such as Monastrol, enastron, enastrol, VS-83, sulfoquinovosylacylglycerols, ispinesib, adociasulfate-2); mitotic kinase inhibitors (such as PLK1 inhibitors wortmannin, scytonemin, staurosporine, ON-019010, BI-2536; aurora kinase inhibitors VX-680, MLN-8054, PHA-680632, PHA-739358, AZD-1152, VX-528, MP-235, Hesperadin, ZM-447439); and separase inhibitors (reviewed in Ivachtchenko et al., 2007, Current Cancer Drug Targets 7:766-784).

"Signature" refers to the differential expression pattern. It could be expressed as the number of individual unique probes whose expression is detected when a cRNA product is used in microarray analysis. A signature may be exemplified by a particular set of biomarkers.

A "similarity value" is a number that represents the degree of similarity between two things being compared. For example, a similarity value may be a number that indicates the overall similarity between a cell sample expression profile using specific phenotype-related biomarkers and a control specific to that template (for instance, the similarity to a "deregulated growth factor signaling pathway" template, where the phenotype is deregulated growth factor signaling pathway status). The similarity value may be expressed as a similarity metric, such as a correlation coefficient, or may simply be expressed as the expression level difference, or the aggregate of the expression level differences, between a cell sample expression profile and a baseline template.

As used herein, the terms "measuring expression levels," "obtaining expression level," and "detecting an expression level" and the like, includes methods that quantify a gene expression level of, for example, a transcript of a gene, or a protein encoded by a gene, as well as methods that determine whether a gene of interest is expressed at all. Thus, an assay which provides a "yes" or "no" result without necessarily providing quantification, of an amount of expression is an assay that "measures expression" as that term is used herein. Alternatively, a measured or obtained expression level may be expressed as any quantitative value, for example, a fold-change in expression, up or down, relative to a control gene or relative to the same gene in another sample, or a log ratio of expression, or any visual representation thereof, such as, for example, a "heatmap" where a color intensity is representative of the amount of gene expression detected. The genes identified as being differentially expressed in tumor cells having growth factor signaling pathway deregulation may be used in a variety of nucleic acid or protein detection assays to detect or quantify the expression level of a gene or multiple genes in a given sample. Exemplary methods for detecting the level of expression of a gene include, but are not limited to, Northern blotting, dot or slot blots, reporter gene matrix (see for example, U.S. Pat. No. 5,569,588) nuclease protection, RT-PCR, microarray profiling, differential display, 2D gel electrophoresis, SELDI-TOF, ICAT, enzyme assay, antibody assay, and the like.

A "patient" can mean either a human or non-human animal, preferably a mammal.

As used herein, "subject", as refers to an organism or to a cell sample, tissue sample or organ sample derived therefrom, including, for example, cultured cell lines, biopsy, blood sample, or fluid sample containing a cell. In many instances, the subject or sample derived therefrom, comprises a plurality of cell types. In one embodiment, the sample includes, for example, a mixture of tumor and normal cells. In one embodiment, the sample comprises at least 10%, 15%, 20%, et seq., 90%, or 95% tumor cells. The organism may be an animal, including but not limited to, an animal, such as a cow, a pig, a mouse, a rat, a chicken, a cat, a dog, etc., and is usually a mammal, such as a human.

As used herein, the term "pathway" is intended to mean a set of system components involved in two or more sequential molecular interactions that result in the production of a product or activity. A pathway can produce a variety of products or activities that can include, for example, intermolecular interactions, changes in expression of a nucleic acid or polypeptide, the formation or dissociation of a complex between two or more molecules, accumulation or destruction of a metabolic product, activation or deactivation of an enzyme or binding activity. Thus, the term "pathway" includes a variety of pathway types, such as, for example, a biochemical pathway, a gene expression pathway, and a regulatory pathway. Similarly, a pathway can include a combination of these exemplary pathway types.

"Growth factor signaling pathway" is initiated by binding of growth factors (including, but not limited to, heregulin, insulin, IGF, FGF, EGF) to receptor tyrosine kinases (including, but not limited to the ERBB family of receptors). The binding of a growth factor to its corresponding receptor leads to receptor dimerization, phosphorylation of key tyrosine residues, and recruitment of several proteins at the intracellular portion of the receptor. These proteins then initiate intracellular signaling via several pathways, such as PI3K/AKT, RAS/ERK, and JAK/STAT signaling pathways, leading to the activation of anti-apoptotic proteins and the inactivation of pro-apoptotic proteins (reviewed in Henson and Gibson, 2006, Cellular Signaling 18:2089-2097). In this application, unless otherwise specified, it will be understood that "growth factor signaling pathway" refers to signaling through PI3K/AKT signaling pathway, initiated by the binding of an external growth factor to a membrane tyrosine kinase receptor.

"PI3K signaling pathway," also known as the "PI3K/AKT signaling pathway" or "AKT signaling pathway" refers to one of the intracellular signaling pathways activated by the binding of growth factors to receptor tyrosine kinases. On activation, PI3K phosphorylates phosphatidylinositol-4,5-bisphosphate (PIP2) to phsophatidylinositol-3,4,5-triphosphate (PIP3), a process that is reversed by PTEN. PIP3 signals activate the kinase PDK1, which in turn activates the kinase AKT.

See also FIG. 1 for an illustration of the PI3K signaling pathway (See also Hennessy et al., 2005, Nat. Rev. Drug Discov. 4:988-1004 for a review of the PI3K/AKT signaling cascade). In addition, the PI3K signaling pathway may also be modulated by other intracellular signaling pathways, such as the RAS pathway, resulting in cross-talk among the intracellular signaling pathways activated by the binding of a growth factor to its receptor. The PI3K signaling pathway includes, but is not limited to, the genes, and proteins encoded thereby, listed in Table 1.

TABLE 1

Representative PI3K signaling pathway genes

| Gene Symbol | NCBI Reference Transcript | Description |
| --- | --- | --- |
| PPP2R5A | NM_006243 | protein phosphatase 2, regulatory subunit B', alpha isoform |
| IKBKE | NM_014002 | inhibitor of kappa light polypeptide gene enhancer in B-cells, kinase epsilon |
| FOXO1A | NM_002015 | forkhead box O1 |
| PPP2R3B | NM_013239 | protein phosphatase 2 (formerly 2A), regulatory subunit B'', beta |
| PIK3CA | NM_006218 | phosphoinositide-3-kinase, catalytic, alpha polypeptide |
| MAP3K8 | NM_005204 | mitogen-activated protein kinase kinase kinase 8 |
| NFKBIA | NM_020529 | nuclear factor of kappa light polypeptide gene enhancer in B-cells inhibitor, alpha |
| YWHAE | NM_006761 | tyrosine 3-monooxygenase/tryptophan 5-monooxygenase activation protein, epsilon polypeptide |
| NOS3 | NM_000603 | nitric oxide synthase 3 (endothelial cell) |
| CDC37 | NM_007065 | cell division cycle 37 homolog (*S. cerevisiae*) |
| PIK3R3 | NM_003629 | phosphoinositide-3-kinase, regulatory subunit 3 (p55, gamma) |
| PPP2CB | NM_001009552 | protein phosphatase 2 (formerly 2A), catalytic subunit, beta isoform |
| INPP5D | XM_929960 | inositol polyphosphate-5-phosphatase, 145 kDa |
| IKBKB | NM_001556 | inhibitor of kappa light polypeptide gene enhancer in B-cells, kinase beta |
| PPP2R2A | NM_002717 | protein phosphatase 2 (formerly 2A), regulatory subunit B, alpha isoform |
| RHEB | NM_005614 | Ras homolog enriched in brain |
| TSC1 | NM_000368 | tuberous sclerosis 1 |
| LIMS1 | NM_004987 | LIM and senescent cell antigen-like domains 1 |
| NFKB1 | NM_003998 | nuclear factor of kappa light polypeptide gene enhancer in B-cells 1 (p105) |
| KRAS | NM_004985 | v-Ki-ras2 Kirsten rat sarcoma viral oncogene homolog |
| ILK | NM_001014794 | integrin-linked kinase |
| PIK3R2 | NM_005027 | phosphoinositide-3-kinase, regulatory subunit 2 (p85 beta) |
| CDKN1A | NM_000389 | cyclin-dependent kinase inhibitor 1A (p21, Cip1) |
| PPP2CA | NM_002715 | protein phosphatase 2 (formerly 2A), catalytic subunit, alpha isoform |
| GAB1 | NM_002039 | GRB2-associated binding protein 1 |
| MAP2K1 | NM_002755 | mitogen-activated protein kinase kinase 1 |
| BCL2L1 | NM_001191 | BCL2-like 1 |
| PPP2R5E | NM_006246 | protein phosphatase 2, regulatory subunit B', epsilon isoform |
| RPS6KB1 | NM_003161 | ribosomal protein S6 kinase, 70 kDa, polypeptide 1 |
| NFKBIB | NM_001001716 | nuclear factor of kappa light polypeptide gene enhancer in B-cells inhibitor, beta |
| IKBKG | NM_003639 | inhibitor of kappa light polypeptide gene enhancer in B-cells, kinase gamma |
| PPP2R3A | NM_002718 | protein phosphatase 2 (formerly 2A), regulatory subunit B'', alpha |
| EIF4EBP1 | NM_004095 | eukaryotic translation initiation factor 4E binding protein 1 |
| PIK3R1 | NM_181523 | phosphoinositide-3-kinase, regulatory subunit 1 (p85 alpha) |
| PPP2R5B | NM_006244 | protein phosphatase 2, regulatory subunit B', beta isoform |
| CCND1 | NM_053056 | cyclin D1 |
| AKT1 | NM_001014431 | v-akt murine thymoma viral oncogene homolog 1 |
| MAPK1 | NM_002745 | mitogen-activated protein kinase 1 |
| FRAP1 | NM_004958 | FK506 binding protein 12-rapamycin associated protein 1 |
| MAP3K5 | NM_005923 | mitogen-activated protein kinase kinase kinase 5 |
| TSC2 | NM_001077183 | tuberous sclerosis 2 |
| HRAS | NM_176795 | v-Ha-ras Harvey rat sarcoma viral oncogene homolog |
| SOS1 | NM_005633 | son of sevenless homolog 1 (*Drosophila*) |

TABLE 1-continued

Representative PI3K signaling pathway genes

| Gene Symbol | NCBI Reference Transcript | Description |
|---|---|---|
| PTEN | NM_00314 | phosphatase and tensin homolog (mutated in multiple advanced cancers 1) |
| GSK3B | NM_002093 | glycogen synthase kinase 3 beta |
| RPS6KB2 | NM_001007071 | ribosomal protein S6 kinase, 70 kDa, polypeptide 2 |
| MAP2K2 | NM_030662 | mitogen-activated protein kinase kinase 2 |
| THEM4 | NM_053055 | thioesterase superfamily member 4 |
| PPM1L | NM_139245 | protein phosphatase 1 (formerly 2C)-like |
| NFKB2 | NM_002502 | nuclear factor of kappa light polypeptide gene enhancer in B-cells 2 (p49/p100) |
| PIK3CB | NM_006219 | phosphoinositide-3-kinase, catalytic, beta polypeptide |
| PPP2R1A | NM_014225 | protein phosphatase 2 (formerly 2A), regulatory subunit A, alpha isoform |
| PPP2R2C | NM_020416 | protein phosphatase 2 (formerly 2A), regulatory subunit B, gamma isoform |
| BCL2 | NM_000633 | B-cell CLL/lymphoma 2 |
| GAB2 | NM_080491 | GRB2-associated binding protein 2 |
| JAK1 | NM_002227 | Janus kinase 1 (a protein tyrosine kinase) |
| GYS2 | NM_021957 | glycogen synthase 2 (liver) |
| PPM1J | NM_005167 | protein phosphatase 1J (PP2C domain containing) |
| GRB2 | NM_002086 | growth factor receptor-bound protein 2 |
| BAD | NM_032989 | BCL2-antagonist of cell death |
| TP53 | NM_000546 | tumor protein p53 (Li-Fraumeni syndrome) |
| NRAS | NM_002524 | neuroblastoma RAS viral (v-ras) oncogene homolog |
| PPP2R5D | NM_180977 | protein phosphatase 2, regulatory subunit B', delta isoform |
| PPP2R2B | NM_181677 | protein phosphatase 2 (formerly 2A), regulatory subunit B, beta isoform |
| MDM2 | NM_006879 | Mdm2, transformed 3T3 cell double minute 2, p53 binding protein (mouse) |
| GSK3A | NM_019884 | glycogen synthase kinase 3 alpha |
| HSP90AA1 | NM_001017963 | heat shock protein 90 kDa alpha (cytosolic), class A member 1 |
| PIK3CD | NM_005026 | phosphoinositide-3-kinase, catalytic, delta polypeptide |
| MYH4 | NM_017533 | myosin, heavy chain 4, skeletal muscle |
| MAPK3 | NM_002746 | mitogen-activated protein kinase 3 |
| YWHAQ | NM_006826 | tyrosine 3-monooxygenase/tryptophan 5-monooxygenase activation protein, theta polypeptide |
| SOS2 | NM_006939 | son of sevenless homolog 2 (*Drosophila*) |
| EIF4E | NM_001968 | eukaryotic translation initiation factor 4E |
| SFN | NM_006142 | stratifin |
| AKT3 | NM_181690 | v-akt murine thymoma viral oncogene homolog 3 (protein kinase B, gamma) |
| CDKN1B | NM_004064 | cyclin-dependent kinase inhibitor 1B (p27, Kip1) |
| CTNNB1 | NM_001904 | catenin (cadherin-associated protein), beta 1, 88 kDa |
| HSP90AB1 | NM_007355 | heat shock protein 90 kDa alpha (cytosolic), class B member 1 |
| PDPK1 | NM_002613 | 3-phosphoinositide dependent protein kinase-1 |
| AKT2 | NM_001626 | v-akt murine thymoma viral oncogene homolog 2 |
| PPP2R1B | NM_181699 | protein phosphatase 2 (formerly 2A), regulatory subunit A, beta isoform |
| INPPL1 | NM_001567 | inositol polyphosphate phosphatase-like 1 |
| GYS1 | NM_002103 | glycogen synthase 1 (muscle) |
| RAF1 | NM_002880 | v-raf-1 murine leukemia viral oncogene homolog 1 |
| CHUK | NM_001278 | conserved helix-loop-helix ubiquitous kinase |
| PPP2R4 | NM_021131 | protein phosphatase 2A activator, regulatory subunit 4 |
| MAPK8IP1 | NM_005456 | mitogen-activated protein kinase 8 interacting protein 1 |
| PPP2R5C | NM_178586 | protein phosphatase 2, regulatory subunit B', gamma isoform |
| cMET | NM_000245 | met proto-oncogene (hepatocyte growth factor receptor) |
| EGFR | NM_005228 | epidermal growth factor receptor (erythroblastic leukemia viral (v-erb-b) oncogene homolog, avian) |
| IGF1R | NM_000875 | insulin-like growth factor 1 receptor |
| KDR | NM_002253 | kinase insert domain receptor (a type III receptor tyrosine kinase) |
| ABL | NM_007313 | v-abl Abelson murine leukemia viral oncogene homolog 1 |
| SRC | NM_005417 | v-src sarcoma (Schmidt-Ruppin A-2) viral oncogene homolog (avian) |
| PKD1 | NM_000296 | polycystic kidney disease 1 (autosomal dominant) |
| PKN3 | NM_013355 | Protein kinase N3 |
| MAP3K8 | NM_005204 | mitogen-activated protein kinase kinase kinase 8 |
| RAF1 | NM_002880 | v-raf-1 murine leukemia viral oncogene homolog 1 |

"Growth factor pathway agent" refers to an agent which modulates growth factor pathway signaling through the PI3K/AKT signaling arm. A growth factor pathway inhibitor inhibits growth factor pathway signaling through the PI3K/AKT signaling arm. Molecular targets of such inhibitors may include PI3K, AKT, mTOR, PDK1, MYC, cMET, FGFR2, growth factors (EGF, b-FGF, IGF1, Insulin, or Heregulin) and their corresponding receptors, and any of the genes listed in Table 1. Such agents are well known in the art and include, but are not limited to: phosphatidylinositol ether lipid analogs, alkylphospholipid analogs, allosteric AKT inhibitors, HSP90 inhibitor, alkylphospholipid perifosine, rapamycin, RAD001, FTY720, PDK1 inhibitors (BX-795, BX-912, and BX-320 (Feldman et al., 2005, J. Biol. Chem. 280:19867-19874); 7-hydroxystaurosporine (Sato et al., 2002, Oncogene, 21:1727-1738)); PI3K inhibitors (wortmannin (Wymann et al., 1996, Mol. Cell. Biol. 16:1722-1733); LY294002 (Vlahos et al., 1994, J. Biol. Chem. 269:5241-5248; Wetzker and Rommel, 2004, Curr. Pharm. Des. 10:1915-1922); IC87114 (Finan and Thomas, 2004, Biochem. Soc. Trans. 32:378-382; WO0181346); WO01372557; U.S. Pat. No. 6,403,588; WO0143266); AKT antibodies (Shin et al., 2005, Cancer Res. 65:2815-2824) (see also Cheng et al., Oncogene, 2005, 24:7482-7492 for review on inhibitors of AKT pathway), and IGF1R inhibitors (such as monoclonal antibody MK-0646 U.S. Pat. No. 7,241,444). The inhibitors and agents listed in the Examples section that were used to identify and refine the growth factor signaling pathway biomarkers are also exemplary growth factor pathway agents (i.e., AKT1/2 inhibitors L-001154547 ('547; 3-phenyl-2-(4-{[4-(5-pyridin-2-yl-1H-1,2,4-triazol-3-yl)piperidin-1-yl]methyl}phenyl)-1,6-naphthyridin-5(6H)-one; disclosed in WO2006065601), L-01173931 ('931; 6-Methyl-3-phenyl-2-(4-{[4-(5-pyridin-2-yl-1H-1,2,4-triazol-3-yl)piperidin-1-yl]-methyl}phenyl)-1,6-naphthyridin-5(6H)-one; disclosed in WO2006065601; gamma secretase inhibitor 421B (U.S. Pat. No. 7,138,400 and WO02/36555); cMET inhibitors L-001501404 (4-(6-Phenyl-[1,2,4]triazolo[4,3-b][1,2,4]triazin-3-ylmethyl)-phenol, see also U.S. Pat. No. 7,122,548), MK-2461 (N-[(2R)-1,4-dioxan-2-ylmethyl]-N-methyl-N'-[3-(1-methyl-1H-pyrazol-4-yl)-5-oxo-5H-benzo[4,5]cyclohepta[1,2-b]pyridin-7-yl]sulfamide), and L-001793225 (1-[3-(1-Methyl-1H-pyrazol-4-yl)-5-oxo-5H-benzo[4,5]cyclohepta[1,2-b]pyridin-7-yl]-N-(pyridin-2-ylmethyl) methanesulfonamide.

The term "deregulated growth factor signaling pathway" is used herein to mean that the growth factor signaling pathway is either hyperactivated or hypoactivated. A growth factor signaling pathway is hyperactivated in a sample (for example, a tumor sample) if it has at least 10%, 20%, 50%, 75%, 100%, 200%, 500%, 1000% greater activity/signaling than the growth factor signaling pathway in a normal (regulated) sample. A growth factor signaling pathway is hypoactivated if it has at least 10%, 20%, 50%, 75%, 100% less activity/signaling in a sample (for example, a tumor sample) than the growth factor signaling pathway in a normal (regulated) sample. The normal sample with the regulated growth factor signaling pathway may be from adjacent normal tissue or may be other tumor samples which do not have deregulated growth factor signaling. Alternatively, comparison of samples growth factor signaling pathway status may be done with identical samples which have been treated with a drug or agent vs. vehicle. The change in activation status may be due to a mutation of one or more genes in the growth factor signaling pathway (such as point mutations, deletion, or amplification), changes in transcriptional regulation (such as methylation, phosphorylation, or acetylation changes), or changes in protein regulation (such as translation or post-translational control mechanisms).

The term "glycolysis pathway" or "glycolytic pathway" refers to the oxygen-independent cellular energy production pathway that breaks down one molecule of glucose into 2 molecules of pyruvate, resulting in the production of 2 ATP. Pyruvate is then reduced to lactate in the glycolysis pathway. In the presence of oxygen, pyruvate is oxidized to $HCO_3$, generating 36 additional ATP per glucose (oxidative phosphorylation pathway). Conversion of glucose to lactic acid in the presence of oxygen is also called "aerobic glycolysis" or the "Warburg effect." Increased glycolysis in the presence of oxygen (aerobic glycoclysis) is a hallmark of primary and metastatic cancers (reviewed in Gatenby and Gillies, 2004, Nature Reviews Cancer 4:891-899; Lopez-Lazaro, 2008, Anti-Cancer Agents in Med. Chem., 8:305-312; Kondoh, 2008, Exp. Cell Res. 314:1923-1928).

"Glycolysis pathway agent" refers to an agent which modulates the glycolysis pathway. A glycolysis inhibitor inhibits the glycolysis pathway. Molecular targets of such inhibitors include hexokinase, phosphofructokinase, pyruvate kinase, glucose transporters. Such agents are well known in the art and include, but are not limited to: lonidamine, 3-bromopyruvate, 2-deoxyglucose, imatinib, ATP citrate lyase inhibitor SB-204990, oxythiamine, genistein, 5-thioglucose, mannoheptulose, α-chlorohydrin, ornidazole, glufosfamide, arsenic compounds, oxamate, iodoacetate, bisphosphonates, tubercidin, and $Na^+/K^+$-ATPase pump inhibitors, GLUT inhibitors, 3-(3-pyridinyl)-1-(4-pyridinyl)-2-propen-1-one, dichloroacetate (reviewed in Lopez-Lazaro, 2008, Anti-Cancer Agents in Medicinal Chemistry 8:305-312; Clem et al., 2008, Mol. Cancer Ther. 7:110-120; Bonnet et al., 2007, Cancer Cell 11:37-51).

The term "oncogenic pathway" is used herein to mean a pathway that when hyperactivated or hypoactivated contributes to cancer initiation or progression. In one embodiment, an oncogenic pathway is one that contains an oncogene or a tumor suppressor gene.

The term "treating" in its various grammatical forms in relation to the present invention refers to preventing (i.e. chemoprevention), curing, reversing, attenuating, alleviating, minimizing, suppressing, or halting the deleterious effects of a disease state, disease progression, disease causative agent (e.g. bacteria or viruses), or other abnormal condition. For example, treatment may involve alleviating a symptom (i.e., not necessarily all the symptoms) of a disease of attenuating the progression of a disease.

"Treatment of cancer," as used herein, refers to partially or totally inhibiting, delaying, or preventing the progression of cancer including cancer metastasis; inhibiting, delaying, or preventing the recurrence of cancer including cancer metastasis; or preventing the onset or development of cancer (chemoprevention) in a mammal, for example, a human. In addition, the methods of the present invention may be practiced for the treatment of human patients with cancer. However, it is also likely that the methods would also be effective in the treatment of cancer in other mammals.

As used herein, the term "therapeutically effective amount" is intended to qualify the amount of the treatment in a therapeutic regiment necessary to treat cancer. This includes combination therapy involving the use of multiple therapeutic agents, such as a combined amount of a first and second treatment where the combined amount will achieve the desired biological response. The desired biological response is partial or total inhibition, delay, or prevention of the progression of cancer including cancer metastasis; inhibition, delay, or prevention of the recurrence of cancer including cancer metastasis; or the prevention of the onset of development of cancer (chemoprevention) in a mammal, for example, a human.

"Displaying or outputting a classification result, prediction result, or efficacy result" means that the results of a gene expression based sample classification or prediction are communicated to a user using any medium, such as for example, orally, writing, visual display, etc., computer readable medium or computer system. It will be clear to one skilled in the art that outputting the result is not limited to outputting to a user or a linked external component(s), such as a computer system or computer memory, but may alternatively or additionally be outputting to internal components, such as any computer readable medium. Computer readable media may include, but are not limited to hard drives, floppy disks, CD-ROMs, DVDs, DATs. Computer readable media does not include carrier waves or other wave forms for data transmission. It will be clear to one skilled in the art that the various sample classification methods disclosed and claimed herein, can, but need not be, computer-implemented, and that, for example, the displaying or outputting step can be done by, for example, by communicating to a person orally or in writing (e.g., in handwriting).

3.3 Biomarkers Useful in Classifying Tumors and Predicting Response to Therapeutic Agents 3.3.1 Biomarker Sets One aspect of the invention provides a set of 101 biomarkers whose expression is correlated with growth factor signaling pathway deregulation by clustering analysis. These biomarkers identified as useful for classifying tumors according to regulation status of the growth factor signaling pathway, predicting response of a cancer patient to a compound that modulates the growth factor signaling pathway, or measuring pharmacodynamic effect on the growth factor signaling pathway of a therapeutic agent, are listed as SEQ ID NOs: 1, 3, 5, 7, 9, 11, 13, 15, 17, 19, 21, 23, 25, 27, 29, 31, 33, 35, 37, 39, 41, 43, 45, 72, 73, 75, 77, 79, 81, 83, 85, 87, 89, 91, 93, 95, 109, 111, 113, 115, 117, 119, 121, 123, 125, 127, 129, 130, 132, 134, 136, 138, 140, 142, 144, 146, 148, 149, 151, 153, 155, 157, 46, 48, 50, 52, 54, 56, 58, 60, 62, 64, 66, 68, 70, 97, 99, 101, 103, 105, 107, 159, 161, 163, 165, 167, 169, 171, 173, 175, 177, 179, 181, 183, 185, 187, 189, 191, 193, and 195 (see also Tables 5a and 5b). Another aspect of the invention provides a method of using these biomarkers to distinguish tumor types in diagnosis or to predict response to therapeutic agents. In one embodiment of the invention, the 101 biomarker set may be split into two opposing "arms"—the "up" arm (see Tables 5a and 5b), which are the genes that are upregulated, and the "down" arm, which are the genes that are downregulated, as signaling through the growth factor pathway increases.

In one embodiment, the invention provides a set of 101 biomarkers that can classify tumors by growth factor signaling pathway regulation status, i.e. distinguish between tumors having regulated and deregulated growth factor signaling pathways. These biomarkers are listed in Table 5a and 5b. The invention also provides subsets of at least 5, 10, 20, 30, 40, 50, 75, or 100 biomarkers, drawn from the set of 101, that can distinguish between tumors having deregulated and regulated growth factor signaling pathways. In an alternative embodiment, a subset of 20 biomarkers drawn from the 101, is listed in Table 10. Alternatively, a subset of at least 3, 5, 10, 15, 20, 25 biomarkers, drawn from the "up" arm (see Table 5a) and a subset of at least 3, 5, 10, 15, 20, 25 biomarkers from the "down" arm (see Table 5b) that can distinguish between tumors having deregulated and regulated growth factor signaling pathways are provided. In one embodiment, a subset of the "up" arm biomarkers and "down" arm biomarkers is listed in Table 10. The invention also provides a method of using the above biomarkers to distinguish between tumors having deregulated or regulated growth factor signaling pathway.

In another embodiment, the invention provides a set of 101 genetic biomarkers that can be used to predict response of a subject to a growth factor signaling pathway agent. In a more specific embodiment, the invention provides a subset of at least 5, 10, 20, 30, 40, 50, 75, or 100 biomarkers, drawn from the set of 101, that can be used to predict the response of a subject to an agent that modulates the growth factor signaling pathway. In another embodiment, the invention provides a set of 101 biomarkers that can be used to select a growth factor pathway agent for treatment of a subject with cancer. In a more specific embodiment, the invention provides a subset of at least 5, 10, 20, 30, 40, 50, 75, or 100 biomarkers, drawn from the set of 101 that can be used to select a growth factor pathway agent for treatment of a subject with cancer. Alternatively, a subset of at least 3, 5, 10, 15, 20, 25 biomarkers, drawn from the "up" arm (see Table 5a) and a subset of at least 3, 5, 10, 15, 20, 25 biomarkers from the "down" arm (see Table 5b) can be used to predict response of a subject to a growth factor signaling pathway agent or to select a growth factor signaling pathway agent for treatment of a subject with cancer. In a particular embodiment, a subset of biomarkers is listed in Table 10.

In another embodiment, the invention provides a set of 101 genetic biomarkers that can be used to determine whether an agent has a pharmacodynamic effect on the growth factor signaling pathway. The biomarkers provided may be used to monitor inhibition of the growth factor signaling pathway at various time points following treatment with said agent. In a more specific embodiment, the invention provides a subset of at least 5, 10, 20, 30, 40, 50, 75, or 100 biomarkers, drawn from the set of 101, that can be used to monitor pharmacodynamic activity of an agent on the growth factor signaling pathway. Alternatively, a subset of at least 3, 5, 10, 15, 20, 25 biomarkers, drawn from the "up" arm (see Table 5a) and a subset of at least 3, 5, 10, 15, 20, 25 biomarkers from the "down" arm (see Table 5b) can be used to determine whether an agent has a pharmacodynamic effect on the growth factor signaling pathway or monitor pharmacodynamic activity of an agent on the growth factor signaling pathway. In a particular embodiment, a subset of biomarkers is listed in Table 10.

The invention also provides an alternative set of 86 genetic biomarkers whose expression is correlated with growth factor signaling pathway deregulation by clustering analysis. These biomarkers identified as useful for classifying tumors according to regulation status of the growth factor signaling pathway, predicting response of a subject to a compound that modulates the growth factor signaling pathway, or measuring pharmacodynamic effect on the growth factor signaling pathway of a therapeutic agent, are listed as SEQ ED NOs: 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, and 371 (see also Table 11). Another aspect of the invention provides a method of using these biomarkers to distinguish tumor types in diagnosis or to predict response to therapeutic agents. In one embodiment of the invention, the 86 biomarker set may be split into two opposing "arms"—the "up" arm, comprising 44 genes (see Table 11), which are the genes that are upregulated, and the "down" arm, comprising 42 genes (see Table 11) which are the genes that are downregulated, as signaling through the growth factor pathway increases. The invention also provides subsets of at least 5, 10, 20, 30, 40, 50, or 75 biomarkers, drawn from the set of 86, that can be used in the various embodiments. Alternatively, a subset of at least 3, 5, 10, 15, 20, 25, 30, or 35 biomarkers, drawn from the "up" arm (see Table 11) and a subset of at least 3, 5, 10, 15, 20, 25, 30, or 35 biomarkers, drawn from the "down" arm (see Table 11) are provided.

Additionally, the invention provides a set of 39 biomarkers whose expression is correlated with glycolysis pathway activity by clustering analysis. These biomarkers identified as useful for classifying tumors according to activity of the glycolysis pathway, predicting response of a cancer patient to a compound that modulates the glycolysis pathway, or measuring pharmacodynamic effect on the glycolysis pathway of a therapeutic agent, are listed as SEQ ID NOs: 373, 375, 377, 379, 381, 383, 385, 387, 389, 391, 221, 393, 395, 397, 399, 401, 403, 405, 407, 409, 411, 413, 253, 415, 417, 419, 421, 423, 425, 427, 429, 431, 433, 435, 437, 439, 441, 443, 445 (see also Table 13). Another aspect of the invention provides a method of using these biomarkers to distinguish tumor types in diagnosis or to predict response to therapeutic agents. The invention also provides subsets of at least 5, 10, 20, 30, or 35 biomarkers, drawn from the set of 39 that can be used in the various embodiments.

Any of the sets of biomarkers provided above may be used alone specifically or in combination with biomarkers outside the set. For example, biomarkers that distinguish growth factor signaling pathway regulation status may be used in combination with biomarkers that distinguish p53 functional status (see U.S. provisional application 61/070,259, "Gene Expression Signature for Assessing p53 Pathway Functional Status," by Andrey Loboda et al., filed Mar. 22, 2008). Any of the biomarker sets provided above may also be used in combination with other biomarkers for cancer, or for any other clinical or physiological condition.

3.3.2 Identification of the Biomarkers

The present invention provides sets of biomarkers for the identification of conditions or indications associated with cancer. Generally, the biomarker sets were identified by determining which of ~44,000 human biomarkers had expression patterns that correlated with the conditions or indications.

In one embodiment, the method for identifying biomarker sets is as follows. After extraction and labeling of target polynucleotides, the expression of all biomarkers (genes) in a sample X is compared to the expression of all biomarkers in a standard or control. In one embodiment, the standard or control comprises target polynucleotides derived from a sample from a normal individual (i.e. an individual not having growth factor pathway deregulation). Alternatively, the standard or control comprises polynucleotides derived from normal tissue adjacent to a tumor or from tumors not have growth factor pathway deregulation. In a preferred embodiment, the standard or control is a pool of target polynucleotide molecules. The pool may be derived from collected samples from a number of normal individuals. In another embodiment, the pool comprises samples taken from a number of individuals with tumors not having growth factor pathway deregulation. In another preferred embodiment, the pool comprises an artificially-generated population of nucleic acids designed to approximate the level of nucleic acid derived from each biomarker found in a pool of biomarker-derived nucleic acids derived from tumor samples. In yet another embodiment, the pool is derived from normal or cancer lines or cell line samples.

The comparison may be accomplished by any means known in the art. For example, expression levels of various biomarkers may be assessed by separation of target polynucleotide molecules (e.g. RNA or cDNA) derived from the biomarkers in agarose or polyacrylamide gels, followed by hybridization with biomarker-specific oligonucleotide probes. Alternatively, the comparison may be accomplished by the labeling of target polynucleotide molecules followed by separation on a sequencing gel. Polynucleotide samples are placed on the gel such that patient and control or standard polynucleotides are in adjacent lanes. Comparison of expression levels is accomplished visually or by means of densitometer. In a preferred embodiment, the expression of all biomarkers is assessed simultaneously by hybridization to a microarray. In each approach, biomarkers meeting certain criteria are identified as associated with tumors having growth factor signaling pathway deregulation.

A biomarker is selected based upon significant difference of expression in a sample as compared to a standard or control condition. Selection may be made based upon either significant up- or down regulation of the biomarker in the patient sample. Selection may also be made by calculation of the statistical significance (i.e., the p-value) of the correlation between the expression of the biomarker and the condition or indication. Preferably, both selection criteria are used. Thus, in one embodiment of the invention, biomarkers associated with deregulation growth factor signaling pathway in a tumor are selected where the biomarkers show both more than two-fold change (increase or decrease) in expression as compared to a standard, and the p-value for the correlation between the existence of growth factor signaling pathway deregulation and the change in biomarker expression is no more than 0.01 (i.e., is statistically significant).

Expression profiles comprising a plurality of different genes in a plurality of N cancer tumor samples can be used to identify markers that correlate with, and therefore are useful for discriminating different clinical categories. In a specific embodiment, a correlation coefficient $\rho$ between a vector $\vec{c}$ representing clinical categories or clinical parameters, e.g., a regulated or deregulated growth factor signaling pathway, in the N tumor samples and a vector $\vec{r}$ representing the measured expression levels of a gene in the N tumor samples is used as a measure of the correlation between the expression level of the gene and growth factor signaling pathway status. The expression levels can be a measured abundance level of a transcript of the gene, or any transformation of the measured abundance, e.g., a logarithmic or a log ratio. Specifically, the correlation coefficient may be calculated as:

$$\rho = (\vec{c} \cdot \vec{r}) / (\|\vec{c}\| \cdot \|\vec{r}\|) \qquad (1)$$

Biomarkers for which the coefficient of correlation exceeds a cutoff are identified as growth factor pathway signaling status-informative biomarkers specific for a particular clinical category, e.g., deregulated growth factor pathway signaling status, within a given patient subset. Such a cutoff or threshold may correspond to a certain significance of the set of obtained discriminating genes. The threshold may also be selected based on the number of samples used. For example, a threshold can be calculated as $3 \times 1/\sqrt{n-3}$, where $1/\sqrt{n-3}$ is the distribution width and n=the number of samples. In a specific embodiment, markers are chosen if the correlation coefficient is greater than about 0.3 or less than about −0.3.

Next, the significance of the set of biomarker genes can be evaluated. The significance may be calculated by any appropriate statistical method. In a specific example, a Monte-Carlo technique is used to randomize the association between the expression profiles of the plurality of patients and the clinical categories to generate a set of randomized data. The same biomarker selection procedure as used to select the biomarker set is applied to the randomized data to obtain a control biomarker set. A plurality of such runs can be performed to generate a probability distribution of the number of genes in control biomarker sets. In a preferred embodiment, 10,000 such runs are performed. From the probability distribution, the probability of finding a biomarker set consisting of a given number of biomarkers when no correlation between the expression levels and phenotype is expected (i.e., based randomized data) can be determined. The significance of the biomarker set obtained from the real data can be evaluated based on the number of biomarkers in the biomarker set by comparing to the probability of obtaining a control biomarker set consisting of the same number of biomarkers using the randomized data. In one embodiment, if the probability of obtaining a control biomarker set consisting of the same number of biomarkers using the randomized data is below a given probability threshold, the biomarker set is said to be significant.

Once a biomarker set is identified, the biomarkers may be rank-ordered in order of correlation or significance of discrimination. One means of rank ordering is by the amplitude of correlation between the change in gene expression of the biomarker and the specific condition being discriminated. Another, preferred, means is to use a statistical metric. In a specific embodiment, the metric is a t-test-like statistic:

$$t = \frac{(\langle x_1 \rangle - \langle x_2 \rangle)}{\sqrt{[\sigma_1^2(n_1 - 1) + \sigma_2^2(n_2 - 1)]/(n_1 + n_2 - 1)/(1/n_1 + 1/n_2)}} \quad (2)$$

In this equation, $\langle x_1 \rangle$ is the error-weighted average of the log ratio of transcript expression measurements within a first clinical group (e.g., deregulated growth factor pathway signaling), $\langle x_2 \rangle$ is the error-weighted average of log ratio within a second, related clinical group (e.g., regulated growth factor pathway signaling), $\sigma_1$ is the variance of the log ratio within the first clinical group (e.g., deregulated growth factor pathway signaling), $n_1$ is the number of samples for which valid measurements of log ratios are available, $\sigma_2$ is the variance of log ratio within the second clinical group (e.g., regulated growth factor pathway signaling), and $n_2$ is the number of samples for which valid measurements of log ratios are available. The t-value represents the variance-compensated difference between two means. The rank-ordered biomarker set may be used to optimize the number of biomarkers in the set used for discrimination.

A set of genes for growth factor pathway signaling status can also be identified using an iterative approach. This is accomplished generally in a "leave one out" method as follows. In a first run, a subset, for example five, of the biomarkers from the top of the ranked list is used to generate a template, where out of N samples, N−1 are used to generate the template, and the status of the remaining sample is predicted. This process is repeated for every sample until every one of the N samples is predicted once. In a second run, one or more additional biomarkers, for example five additional biomarkers, are added, so that a template is now generated from 10 biomarkers, and the outcome of the remaining sample is predicted. This process is repeated until the entire set of biomarkers is used to generate the template. For each of the runs, type 1 error (false negative) and type 2 errors (false positive) are counted. The set of top-ranked biomarkers that corresponds to lowest type 1 error rate, or type 2 error rate, or preferably the total of type 1 and type 2 error rate is selected.

For growth factor pathway signaling status biomarkers, validation of the marker set may be accomplished by an additional statistic, a survival model. This statistic generates the probability of tumor distant metastases as a function of time since initial diagnosis. A number of models may be used, including Weibull, normal, log-normal, log logistic, log-exponential, or log-Rayleigh (Chapter 12 "Life Testing", S-PLUS 2000 GUIDE TO STATISTICS, Vol. 2, p. 368 (2000)). For the "normal" model, the probability of distant metastases P at time t is calculated as $$P = \alpha \times \exp(-t^2/\tau^2) \quad (3)$$

where $\alpha$ is fixed and equal to 1, and $\tau$ is a parameter to be fitted and measures the "expected lifetime".

It is preferable that the above biomarker identification process be iterated one or more times by excluding one or more samples from the biomarker selection or ranking (i.e., from the calculation of correlation). Those samples being excluded are the ones that can not be predicted correctly from the previous iteration. Preferably, those samples excluded from biomarker selection in this iteration process are included in the classifier performance evaluation, to avoid overstating the performance.

Once a set of genes for growth factor pathway signaling status has been identified, the biomarkers may be split into two opposing "arms"—the "up" arm (see Table 5a or Table 11), which are the genes that are upregulated, and the "down" arm (see Table 5b or Table 11), which are the genes that are downregulated, as signaling through the growth factor pathway increases.

It will be apparent to those skilled in the art that the above methods, in particular the statistical methods, described above, are not limited to the identification of biomarkers associated with growth factor signaling pathway regulation status, but may be used to identify set of biomarker genes associated with any phenotype. The phenotype can be the presence or absence of a disease such as cancer, or the presence or absence of any identifying clinical condition associated with that cancer. The above described methods may be used to identify biomarkers associated with glycolysis pathway activity, for example. In the disease context, the phenotype may be prognosis such as survival time, probability of distant metastases of disease condition, or likelihood of a particular response to a therapeutic or prophylactic regimen. The phenotype need not be cancer, or a disease; the phenotype may be a nominal characteristic associated with a healthy individual.

3.3.3 Sample Collection

In the present invention, target polynucleotide molecules are typically extracted from a sample taken from an individual afflicted with cancer or tumor cell lines, and corresponding normal/control tissues or cell lines, respectively. The sample may be collected in any clinically acceptable manner, but must be collected such that biomarker-derived polynucleotides (i.e., RNA) are preserved. mRNA or nucleic acids derived therefrom (i.e., cDNA or amplified DNA) are preferably labeled distinguishably from standard or control polynucleotide molecules, and both are simultaneously or independently hybridized to a microarray comprising some or all of the biomarkers or biomarker sets or subsets described above. Alternatively, mRNA or nucleic acids derived therefrom may be labeled with the same label as the standard or control polynucleotide molecules, wherein the intensity of hybridization of each at a particular probe is compared. A sample may comprise any clinically relevant tissue sample, such as a tumor biopsy or fine needle aspirate, or a sample of bodily fluid, such as blood, plasma, serum, lymph, ascitic fluid, cystic fluid, urine. The sample may be taken from a human, or, in a veterinary context, from non-human animals such as ruminants, horses, swine or sheep, or from domestic companion animals such as felines and canines. Additionally, the samples may be from frozen or archived formalin-fixed, paraffin-embedded (FFPE) tissue samples.

Methods for preparing total and poly(A)+ RNA are well known and are described generally in Sambrook et al., MOLECULAR CLONING—A LABORATORY MANUAL (2ND ED.), Vols. 1-3, Cold Spring Harbor Laboratory, Cold Spring Harbor, N.Y. (1989)) and Ausubel et al., CURRENT PROTOCOLS IN MOLECULAR BIOLOGY, vol. 2, Current Protocols Publishing, New York (1994)).

RNA may be isolated from eukaryotic cells by procedures that involve lysis of the cells and denaturation of the proteins contained therein. Cells of interest include wild-type cells (i.e., non-cancerous), drug-exposed wild-type cells, tumor- or tumor-derived cells, modified cells, normal or tumor cell line cells, and drug-exposed modified cells.

Additional steps may be employed to remove DNA. Cell lysis may be accomplished with a nonionic detergent, followed by microcentrifugation to remove the nuclei and hence the bulk of the cellular DNA. In one embodiment, RNA is extracted from cells of the various types of interest using guanidinium thiocyanate lysis followed by CsCl centrifugation to separate the RNA from DNA (Chirgwin et al., Biochemistry 18:5294-5299 (1979)). Poly(A)+ RNA is selected by selection with oligo-dT cellulose (see Sambrook et al, MOLECULAR CLONING—A LABORATORY MANUAL (2ND ED.), Vols. 1-3, Cold Spring Harbor Laboratory, Cold Spring Harbor, N.Y. (1989). Alternatively, separation of RNA from DNA can be accomplished by organic extraction, for example, with hot phenol or phenol/chloroform/isoamyl alcohol.

If desired, RNase inhibitors may be added to the lysis buffer. Likewise, for certain cell types, it may be desirable to add a protein denaturation/digestion step to the protocol.

For many applications, it is desirable to preferentially enrich mRNA with respect to other cellular RNAs, such as transfer RNA (tRNA) and ribosomal RNA (rRNA). Most mRNAs contain a poly(A) tail at their 3' end. This allows them to be enriched by affinity chromatography, for example, using oligo(dT) or poly(U) coupled to a solid support, such as cellulose or Sephadex® (see Ausubel et al., CURRENT PROTOCOLS IN MOLECULAR BIOLOGY, vol. 2, Current Protocols Publishing, New York (1994). Once bound, poly(A)+ mRNA is eluted from the affinity column using 2 mM EDTA/ 0.1% SDS.

The sample of RNA can comprise a plurality of different mRNA molecules, each different mRNA molecule having a different nucleotide sequence. In a specific embodiment, the mRNA molecules in the RNA sample comprise at least 100 different nucleotide sequences. More preferably, the mRNA molecules of the RNA sample comprise mRNA molecules corresponding to each of the biomarker genes. In another specific embodiment, the RNA sample is a mammalian RNA sample.

In a specific embodiment, total RNA or mRNA from cells is used in the methods of the invention. The source of the RNA can be cells of a plant or animal, human, mammal, primate, non-human animal, dog, cat, mouse, rat, bird, yeast, eukaryote, prokaryote, etc. In specific embodiments, the method of the invention is used with a sample containing total mRNA or total RNA from $1\times10^6$ cells or less. In another embodiment, proteins can be isolated from the foregoing sources, by methods known in the art, for use in expression analysis at the protein level.

Probes to the homologs of the biomarker sequences disclosed herein can be employed preferably wherein non-human nucleic acid is being assayed.

3.4 Methods of Using Growth Factor Signaling Pathway Deregulation Biomarker Sets 3.4.1 Diagnostic/Tumor Classification Methods The invention provides for methods of using the biomarker sets to analyze a sample from an individual so as to determine or classify the individual's tumor type at a molecular level, whether a tumor has a deregulated or regulated growth factor signaling pathway. The individual need not actually be afflicted with cancer. Essentially, the expression of specific biomarker genes in the individual, or a sample taken therefrom, is compared to a standard or control. For example, assume two cancer-related conditions, X and Y. One can compare the level of expression of growth factor signaling pathway biomarkers for condition X in an individual to the level of the biomarker-derived polynucleotides in a control, wherein the level represents the level of expression exhibited by samples having condition X. In this instance, if the expression of the markers in the individual's sample is substantially (i.e., statistically) different from that of the control, then the individual does not have condition X. Where, as here, the choice is bimodal (i.e. a sample is either X or Y), the individual can additionally be said to have condition Y. Of course, the comparison to a control representing condition Y can also be performed. Preferably, both are performed simultaneously, such that each control acts as both a positive and a negative control. The distinguishing result may thus either be a demonstrable difference from the expression levels (i.e. the amount of marker-derived RNA, or polynucleotides derived therefrom) represented by the control, or no significant difference.

Thus, in one embodiment, the method of determining a particular tumor-related status of an individual comprises the steps of (1) hybridizing labeled target polynucleotides from an individual to a microarray containing the above biomarker set or a subset of the biomarkers; (2) hybridizing standard or control polynucleotide molecules to the microarray, wherein the standard or control molecules are differentially labeled from the target molecules; and (3) determining the difference in transcript levels, or lack thereof, between the target and standard or control, wherein the difference, or lack thereof, determines the individual's tumor-related status. In a more specific embodiment, the standard or control molecules comprise biomarker-derived polynucleotides from a pool of samples from normal individuals, a pool of samples from normal adjacent tissue, or a pool of tumor samples from individuals with cancer. In a preferred embodiment, the standard or control is artificially-generated pool of biomarker-derived polynucleotides, which pool is designed to mimic the level of biomarker expression exhibited by clinical samples of normal or cancer tumor tissue having a particular clinical indication (i.e. cancerous or non-cancerous; growth factor signaling pathway regulated or deregulated). In another specific embodiment, the control molecules comprise a pool derived from normal or cancer cell lines.

The present invention provides a set of biomarkers useful for distinguishing deregulated from regulated growth factor signaling pathway tumor types. Thus, in one embodiment of the above method, the level of polynucleotides (i.e., mRNA or polynucleotides derived therefrom) in a sample from an individual, expressed from the biomarkers provided in Tables 5a and 5b are compared to the level of expression of the same biomarkers from a control, wherein the control comprises biomarker-related polynucleotides derived from deregulated growth factor signaling pathway tumor samples, regulated growth factor signaling pathway tumor samples, or both. The comparison may be to both deregulated and regulated growth factor signaling pathway tumor samples, and the comparison may be to polynucleotide pools from a number of deregulated and regulated growth factor signaling pathway tumor samples, respectively. Where the individual's biomarker expression most closely resembles or correlates with the deregulated control, and does not resemble or correlate with the regulated control, the individual is classified as having a deregulated growth factor signaling pathway. Where the pool is not pure deregulated or regulated growth factor signaling pathway type tumors samples, for example, a sporadic pool is used, a set of experiments using individuals with known growth factor signaling pathway status may be hybridized against the pool in order to define the expression templates for the deregulated and regulated group. Each individual with unknown growth factor signaling pathway status is hybridized against the same pool and the expression profile is compared to the template(s) to determine the individual's growth factor signaling pathway status.

In another specific embodiment, the method comprises:

(i) calculating a measure of similarity between a first expression profile and a deregulated growth factor signaling pathway template, or calculating a first measure of similarity between said first expression profile and said deregulated growth factor signaling pathway template and a second measure of similarity between said first expression profile and a regulated growth factor signaling pathway template, said first expression profile comprising the expression levels of a first plurality of genes in the tumor cell sample, said deregulated growth factor signaling pathway template comprising expression levels of said first plurality of genes that are average expression levels of the respective genes in a plurality of tumor cell samples having at least one or more components of said growth factor signaling pathway with abnormal activity, and said regulated growth factor signaling pathway template comprising expression levels of said first plurality of genes that are average expression levels of the respective genes in a plurality of tumor cells samples not having at least one or more components of said growth factor signaling pathway with abnormal activity, said first plurality of genes consisting of at least 5 of the genes for which biomarkers are listed in Table 5a and b;

(ii) classifying said tumor cell sample as having said deregulated growth factor signaling pathway if said first expression profile has a high similarity to said deregulated growth factor signaling pathway template or has a higher similarity to said deregulated growth factor signaling pathway template than to said regulated growth factor signaling pathway template, or classifying said tumor cell sample as having said regulated growth factor signaling pathway if said first expression profile has a low similarity to said deregulated growth factor signaling pathway template or has a higher similarity to said regulated growth factor signaling pathway template than to said deregulated growth factor signaling pathway template; wherein said first expression profile has a high similarity to said deregulated growth factor signaling pathway template if the similarity to said deregulated growth factor signaling pathway template is above a predetermined threshold, or has a low similarity to said deregulated growth factor signaling pathway template if the similarity to said deregulated growth factor signaling pathway template is below said predetermined threshold; and (iii) displaying; or outputting to a user interface device, a computer readable storage medium, or a local or remote computer system; the classification produced by said classifying step (ii).

For the above embodiments, the fullest of biomarkers may be used (i.e., the complete set of biomarkers from Tables 5a and 5b). In other embodiments, subsets of the 101 biomarkers may be used or subsets of the "up" (Table 5a) and "down" (Table 5b) arms of the biomarkers may be used. Alternatively, the fullest of biomarkers from Table 11 may be used, subsets of the 86 biomarkers maybe used, or subsets of the "up" and "down" arms (Table 11) of the biomarkers may be used.

In another embodiment, the expression profile is a differential expression profile comprising differential measurements of said plurality of genes in a sample derived from a patient versus measurements of said plurality of genes in a control sample. The differential measurements can be xdev, log(ratio), error-weighted log(ratio), or a mean subtracted log(intensity) (see, e.g., PCT publication WO00/39339, published on Jul. 6, 2000; PCT publication WO2004/065545, published Aug. 5, 2004, each of which is incorporated herein by reference in its entirety).

The similarity between the biomarker expression profile of a sample or an individual and that of a control can be assessed a number of ways using any method known in the art. For example, Dai et al. describe a number of different ways of calculating gene expression templates and corresponding biomarker genets useful in classifying breast cancer patients (U.S. Pat. No. 7,171,311; WO2002/103320; WO2005/086891; WO2006015312; WO2006/084272). Similarly, Linsley et al. (US2003/0104426) and Radish et al. (US20070154931) disclose gene biomarker genesets and methods of calculating gene expression templates useful in classifying chronic myelogenous leukemia patients. In the simplest case, the profiles can be compared visually in a printout of expression difference data. Alternatively, the similarity can be calculated mathematically.

In one embodiment, the similarity measure between two patients (or samples) x and y, or patient (or sample) x and a template y, can be calculated using the following equation:

$$S = 1 - \left[ \sum_{i=1}^{N_V} \frac{(x_i - \bar{x})}{\sigma_{x_i}} \frac{(y_i - \bar{y})}{\sigma_{y_i}} \bigg/ \sqrt{\sum_{i=1}^{N_V} \left(\frac{x_i - \bar{x}}{\sigma_{x_i}}\right)^2 \sum_{i=1}^{N_V} \left(\frac{y_i - \bar{y}}{\sigma_{y_i}}\right)^2} \right] \quad (4)$$

In this equation, $\chi$ and y are two patients with components of log ratio $x_i$ and $y_i$, i=1, 2, ..., N=4,986. Associated with every value $x_i$ is error $\sigma_{x_i}$. The smaller the value $\sigma_{x_i}$, the more reliable the measurement $$x_i \cdot \bar{x} = \sum_{i=1}^{N_V} \frac{x_i}{\sigma_{x_i}^2} \bigg/ \sum_{i=1}^{N_V} \frac{1}{\sigma_{x_i}^2}$$

is the error-weighted arithmetic mean.

In one embodiment, the similarity is represented by a correlation coefficient between the patient or sample profile and the template. In one embodiment, a correlation coefficient above a correlation threshold indicates high similarity, whereas a correlation coefficient below the threshold indicates low similarity. In some embodiments, the correlation threshold is set as 0.3, 0.4, 0.5, or 0.6. In another embodiment, similarity between a sample or patient profile and a template is represented by a distance between the sample profile and the template. In one embodiment, a distance below a given value indicates a high similarity, whereas a distance equal to or greater than the given value indicates low similarity.

In a preferred embodiment, templates are developed for sample comparison. The template may be defined as the error-weighted log ratio average of the expression difference for the group of biomarker genes able to differentiate the particular growth factor signaling pathway regulation status. For example, templates are defined for deregulated growth factor signaling pathway samples and for regulated growth factor signaling pathway samples. Next, a classifier parameter is calculated. This parameter may be calculated using either expression level differences between the sample and template, or by calculation of a correlation coefficient. Such a coefficient, P can be calculated using the following equation:

$$P_1 = (\vec{c}_i \cdot \vec{y})/(\|\vec{c}_i\| \cdot \|\vec{y}\|) \qquad (5)$$

where i=1 and 2.

As an illustration, in one embodiment, a template for a sample classification based upon one phenotypic endpoint, for example, growth factor signaling pathway deregulated status, is defined as $\vec{c}_1$ (e.g., a profile consisting of correlation values, $C_1$, associated with, for example, growth factor signaling pathway regulation status) and/or a template for second phenotypic endpoint, i.e., growth factor signaling pathway regulated status, is defined as $\vec{c}_2$ (e.g., a profile consisting of correlation values, $C_2$, associated with, for example, growth factor signaling pathway regulation status). Either one or both of the two classifier parameters ($P_1$ and $P_2$) can then be used to measure degrees of similarities between a sample's profile and the templates: $P_1$ measures the similarity between the sample's profile $\vec{y}$ and the first expression template $\vec{c}_1$, and $P_2$ measures the similarity between $\vec{y}$ and the second expression template $\vec{c}_2$.

Thus, in one embodiment, $\vec{y}$ is classified, for example, as a deregulated growth factor signaling pathway profile if $P_1$ is greater than a selected correlation threshold or if $P_2$ is equal to or less than a selected correlation threshold. In another embodiment, $\vec{y}$ is classified, for example, as a regulated growth factor signaling pathway profile if $P_1$ is less than a selected correlation threshold or if $P_2$ is above a selected correlation threshold. In still another embodiment, $\vec{y}$ is classified, for example, as a deregulated growth factor signaling pathway profile if $P_1$ is greater than a first selected correlation threshold and $\vec{y}$ is classified, for example, as a regulated growth factor signaling pathway profile if $P_2$ is greater than a second selected correlation threshold.

Thus, in a more specific embodiment, the above method of determining a particular tumor-related status of an individual comprises the steps of (1) hybridizing labeled target polynucleotides from an individual to a microarray containing one of the above marker sets; (2) hybridizing standard or control polynucleotides molecules to the microarray, wherein the standard or control molecules are differentially labeled from the target molecules; and (3) determining the ratio (or difference) of transcript levels between two channels (individual and control), or simply the transcript levels of the individual; and (4) comparing the results from (3) to the predefined templates, wherein said determining is accomplished by any means known in the art (see Section 3.4.6 on Methods for Classification of Expression Profiles), and wherein the difference, or lack thereof, determines the individual's tumor-related status.

The method can use the complete set of biomarkers listed in Table 5a and 5b. However, subsets of the 101 biomarkers, or the "up" (Table 5a) or "down" (Table 5b) arms of the biomarkers may also be used. Alternatively, the fullest of biomarkers from Table 11 may be used, subsets of the 86 biomarkers maybe used, or subsets of the "up" and "down" arms (Table 11) of the biomarkers may be used.

In another embodiment, the above method of determining the growth factor pathway regulation status of an individual uses the two "arms" of the 101 biomarkers. The "up" arm comprises the 63 genes whose expression goes up with growth factor pathway activation (see Table 5a), and the "down" arm comprises the 38 genes whose expression goes down with growth factor pathway activation (see Table 5b). Alternatively, the above method of determining growth factor pathway regulation status uses the two "arms" of the 86 biomarkers listed in Table 11. The "up" arm comprising 44 genes (see Table 11) and the "down" arm comprising 42 genes (see Table 11). When comparing an individual sample with a standard or control, the expression value of gene X in the sample is compared to the expression value of gene X in the standard or control. For each gene in the set of biomarkers, log(10) ratio is created for the expression value in the individual sample relative to the standard or control (differential expression value). A signature "score" is calculated by determining the mean log(10) ratio of the genes in the "up" and then subtracting the mean log(10) ratio of the genes in the "down" arm. To determine if this signature score is significant, an ANOVA calculation is performed (for example, a two tailed t-test, Wilcoxon rank-sum test, Kolmogorov-Smirnov test, etc.), in which the expression values of the genes in the two opposing arms are compared to one another. For example, if the two tailed t-test is used to determine whether the mean log(10) ratio of the genes in the "up" arm is significantly different than the mean log(10) ratio of the genes in the "down" arm, a p-value of <0.05 indicates that the signature in the individual sample is significantly different from the standard or control. If the signature score for a sample is above a pre-determined threshold, then the sample is considered to have deregulation of the growth factor signaling pathway. The pre-determined threshold may be 0, or may be the mean, median, or a percentile of signature scores of a collection of samples or a pooled sample used as a standard or control. In an alternative embodiment, a subset of at least 3, 5, 10, 15, 20, 25, 30, 35, 40, 45, 50, 55, and 60 of the 63 "up" genes from Table 5a and a subset of at least 3, 5, 10, 15, 20, 25, 30, and 35 of the 38 "down" genes from Table 5b may be used for calculating this signature score. Alternatively, subsets of the 44 "up" genes and subsets of the 42 "down" genes from Table 11 may be used for calculating the signature score. In yet another embodiment, the genes from Table 8b may be used for calculating the signature score. It will be recognized by those skilled in the art that other differential expression values, besides log(10) ratio may be used for calculating a signature score, as long as the value represents an objective measurement of transcript abundance of the biomarker gene. Examples include, but are not limited to: xdev, error-weighted log (ratio), and mean subtracted log(intensity).

The above described methods of using the biomarker sets may also be used to analyze a sample from an individual so as to determine or classify the sample at a molecular level, whether sample has an activated glycolysis pathway, using the set of biomarkers listed in Table 13. The full set or a subset of the 39 biomarkers in Table 13 may be utilized. In the case of the glycolysis signature, all the genes are regulated in the same direction and are correlated. Therefore, this signature consists only of one branch.

The above described methods of using the biomarker sets may also be used to analyze a sample from an individual and then rank order the sample according to its growth factor pathway deregulation status. A sample may be compared to a reference template to determine a ranking order. A sample may also be compared to a pre-determined threshold, such as a mean expression value of a biomarker set or subset for a reference sample, to determine a ranking order. A reference sample may be a "deregulated" or "regulated" growth factor signaling pathway sample. A sample may also be compared to a pool of samples, and rank ordered by comparison with a pre-determined threshold of the pool of samples, such as the mean, median, or percentile expression value of a biomarker set or subset. A sample may also be rank ordered according to its signature score.

3.4.2 Methods of Predicting Response to Treatment and Assigning Treatment

The invention provides a set of biomarkers useful for distinguishing samples from those patients who are predicted to respond to treatment with an agent that modulates the growth factor signaling pathway from patients who are not predicted to respond to treatment an agent that modulates the growth factor signaling pathway. Thus, the invention further provides a method for using these biomarkers for determining whether an individual with cancer is a predicted responder to treatment with an agent that modulates the growth factor signaling pathway. In one embodiment, the invention provides for a method of predicting response of a cancer patient to an agent that modulates the growth factor signaling pathway comprising (1) comparing the level of expression of the biomarkers listed in Tables 5a and 5b in a sample taken from the individual to the level of expression of the same biomarkers in a standard or control, where the standard or control levels represent those found in a sample having a deregulated growth factor signaling; and (2) determining whether the level of the biomarker-related polynucleotides in the sample from the individual is significantly different than that of the control, wherein if no substantial difference is found, the patient is predicted to respond to treatment with an agent that modulates the growth factor signaling pathway, and if a substantial difference is found, the patient is predicted not to respond to treatment with an agent that modulates the growth factor signaling pathway. Persons of skill in the art will readily see that the standard or control levels may be from a tumor sample having a regulated growth factor signaling pathway. In a more specific embodiment, both controls are run. In case the pool is not pure "growth factor regulated" or "growth factor deregulated," a set of experiments of individuals with known responder status should be hybridized against the pool to define the expression templates for the predicted responder and predicted non-responder group. Each individual with unknown outcome is hybridized against the same pool and the resulting expression profile is compared to the templates to predict its outcome.

Growth factor signaling pathway deregulation status of a tumor may indicate a subject that is responsive to treatment with an agent that modulates the growth factor signaling pathway and not responsive to mitotic inhibitors. Therefore, the invention provides for a method of determining or assigning a course of treatment of a cancer patient, comprising determining whether the level of expression of the 101 biomarkers of Table 5a and 5b, or a subset thereof, correlates with the level of these biomarkers in a sample representing deregulated growth factor signaling pathway status or regulated growth factor signaling pathway status; and determining or assigning a course of treatment, wherein if the expression correlates with the deregulated growth factor signaling pathway status pattern, the tumor is treated with an agent that modulates the growth factor signaling pathway and not treated with a mitotic inhibitor type cancer agent.

As with the diagnostic biomarkers, the method can use the complete set of biomarkers listed in Tables 5a and 5b. However, subsets of the 101 biomarkers may also be used. In another embodiment, a subset of at least 5, 10, 20, 30, 40, 50, 75, or 100 biomarkers drawn from the set of 101, can be used to predict the response of a subject to an agent that modulates the growth factor signaling pathway or assign treatment to a subject. Alternatively, the fullest of biomarkers from Table 11 may be used, a subset of at least 5, 10, 20, 30, 40, 50, 60, 70, or 75 of the 86 biomarkers maybe used, or subsets of the "up" and "down" arms (Table 11) of the biomarkers may be used.

Classification of a sample as "predicted responder" or "predicted non-responder" is accomplished substantially as for the diagnostic biomarkers described above, wherein a template is generated to which the biomarker expression levels in the sample are compared.

In another embodiment, the above method of using growth factor pathway regulation status of an individual to predict treatment response or assign treatment uses the two "arms" of the 101 biomarkers. The "up" arm comprises the genes whose expression goes up with growth factor pathway activation (see Table 5a), and the "down" arm comprises the genes whose expression goes down with growth factor pathway activation (see Table 5b). Alternatively, the above method of determining growth factor pathway regulation status uses the two "arms" of the 86 biomarkers listed in Table 11. The "up" arm comprising 44 genes (see Table 11) and the "down" arm comprising 42 genes (see Table 11). When comparing an individual sample with a standard or control, the expression value of gene X in the sample is compared to the expression value of gene X in the standard or control. For each gene in the set of biomarkers, log(10) ratio is created for the expression value in the individual sample relative to the standard or control. A signature "score" is calculated by determining the mean log(10) ratio of the genes in the "up" and then subtracting the mean log(10) ratio of the genes in the "down" arm. If the signature score is above a pre-determined threshold, then the sample is considered to have deregulation of the growth factor signaling pathway. The pre-determined threshold may be 0, or may be the mean, median, or a percentile of signature scores of a collection of samples or a pooled sample used as a standard of control. To determine if this signature score is significant, an ANOVA calculation is performed (for example, a two tailed t-test, Wilcoxon rank-sum test, Kolmogorov-Smirnov test, etc.), in which the expression values of the genes in the two opposing arms are compared to one another. For example, if the two tailed t-test is used to determine whether the mean log(10) ratio of the genes in the "up" arm is significantly different than the mean log(10) ratio of the genes in the "down" arm, a p-value of <0.05 indicates that the signature in the individual sample is significantly different from the standard or control. In an alternative embodiment, a subset of at least 3, 5, 10, 15, 20, 25, 30, 35, 40, 45, 50, 55, and 60 of the 63 "up" genes from Table 5a and a subset of at least 3, 5, 10, 15, 20, 25, 30, and 35 of the 38 "down" genes from Table 5b may be used for calculating this signature score. In yet another embodiment, a subset of at least 3, 5, 10, 15, 20, 25, 30, 35, and 40 of the 44 "up" genes from Table 11 and a subset of at least 3, 5, 10, 15, 20, 25, 30, 35, and 40 of the 42 "down" genes from Table 11 may be used for calculating this signature score. It will be recognized by those skilled in the art that other differential expression values, besides log(10) ratio may be used for calculating a signature score, as long as the value represents an objective measurement of transcript abundance of the biomarker gene. Examples include, but are not limited to: xdev, error-weighted log (ratio), and mean subtracted log(intensity).

The above described methods of using the biomarker sets may also be used to analyze a sample from an individual so as to predict response to agents that modulate the glycolysis pathway, using the set of biomarkers listed in Table 13. The full set or a subset of the 39 biomarkers in Table 13 may be utilized.

The use of the biomarkers is not restricted to predicting response to agents that modulate growth factor signaling pathway for cancer-related conditions, and may be applied in a variety of phenotypes or conditions, clinical or experimental, in which gene expression plays a role. Where a set of biomarkers has been identified that corresponds to two or more phenotypes, the biomarker sets can be used to distinguish these phenotypes. For example, the phenotypes may be the diagnosis and/or prognosis of clinical states or phenotypes associated with cancers and other disease conditions, or other physiological conditions, prediction of response to agents that modulate pathways other than the growth factor signaling pathway, wherein the expression level data is derived from a set of genes correlated with the particular physiological or disease condition.

3.4.3 Method of Determining Whether an Agent Modulates the Growth Factor Signaling Pathway The invention provides a set of biomarkers useful for and methods of using the biomarkers for identifying or evaluating an agent that is predicted to modify or modulate the growth factor signaling pathway in a subject. "Growth factor signaling pathway" is initiated by binding of growth factors (including, but not limited to, heregulin, insulin, IGF, FGF, EGF) to receptor tyrosine kinases (including, but not limited to the ERBB family of receptors). The binding of a growth factor to its corresponding receptor leads to receptor dimerization, phosphorylation of key tyrosine residues, and recruitment of several proteins at the intracellular portion of the receptor. These proteins then initiate intracellular signaling via several pathways, such as PI3K/AKT, RAS/ERK, and JAK/STAT signaling pathways, leading to the activation of anti-apoptotic proteins and the inactivation of pro-apoptotic proteins (reviewed in Henson and Gibson, 2006, Cellular Signaling 18:2089-2097). In this application, unless otherwise specified, it will be understood that "growth factor signaling pathway" refers to signaling through PI3K/AKT signaling pathway, initiated by the binding of an external growth factor to a membrane tyrosine kinase receptor.

"PI3K signaling pathway," also known as the "PI3K/AKT signaling pathway" or "AKT signaling pathway" refers to one of the intracellular signaling pathways activated by the binding of growth factors to receptor tyrosine kinases. On activation, PI3K phosphorylates phosphatidylinositol-4,5-bisphosphate (PIP2) to phsophatidylinositol-3,4,5-triphosphate (PIP3), a process that is reversed by PTEN. PIP3 signals activate the kinase PDK1, which in turn activates the kinase AKT.

See also FIG. 1 for an illustration of the PI3K signaling pathway (See also Hennessy et al., 2005, Nat. Rev. Drug Discov. 4:988-1004 for a review of the PI3K/AKT signaling cascade). In addition, the PI3K signaling pathway may also be modulated by other intracellular signaling pathways, such as the RAS pathway, resulting in cross-talk among the intracellular signaling pathways activated by the binding of a growth factor to its receptor. The PI3K signaling pathway includes, but is not limited to, the genes, and proteins encoded thereby, listed in Table 1.

Agents affecting the growth factor signaling pathway include small molecule compounds; proteins or peptides (including antibodies); siRNA, shRNA, or microRNA molecules; or any other agents that modulate one or more genes or proteins that function within the growth factor signaling pathway or other signaling pathways that interact with the growth factor signaling pathway, such as the RAS pathway.

"Growth factor pathway agent" refers to an agent which modulates growth factor pathway signaling through the PI3K/AKT signaling arm. A growth factor pathway inhibitor inhibits growth factor pathway signaling through the PI3K/AKT signaling arm. Molecular targets of such inhibitors may include PI3K, AKT, mTOR, PDK1, MYC, cMET, FGFR2, and any of the genes listed in Table 1. Such agents are well known in the art and include, but are not limited to: phosphatidylinositol ether lipid analogs, alkylphospholipid analogs, allosteric AKT inhibitors, HSP90 inhibitor, alkylphospholipid perifosine, rapamycin, RAD001, FTY720, PDK1 inhibitors (BX-795, BX-912, and BX-320 (Feldman et al., 2005, J. Biol. Chem. 280:19867-19874); 7-hydroxystaurosporine (Sato et al., 2002, Oncogene, 21:1727-1738)); PI3K inhibitors (wortmannin (Wymann et al., 1996, Mol. Cell. Biol. 16:1722-1733); LY294002 (Wetzker and Rommel, 2004, Curr. Pharm. Des. 10:1915-1922); IC87114 (Finan and Thomas, 2004, Biochem. Soc. Trans. 32:378-382; WO0181346); WO01372557; U.S. Pat. No. 6,403,588; WO0143266); and AKT antibodies (Shin et al., 2005, Cancer Res. 65:2815-2824) (see also Cheng et al., Oncogene, 2005, 24:7482-7492 for review on inhibitors of AKT pathway). The inhibitors listed in the Examples section that were used to identify and refine the growth factor signaling pathway biomarkers are also exemplary growth factor pathway agents (i.e., AKT1/2 inhibitors L-001154547 ('547; 3-phenyl-2-(4-{[4-(5-pyridin-2-yl-1H-1,2,4-triazol-3-yl)piperidin-1-yl] methyl}phenyl)-1,6-naphthyridin-5(6H)-one; disclosed in WO2006065601), L-01173931 ('931; 6-Methyl-3-phenyl-2-(4-{[4-(5-pyridin-2-yl-1H-1,2,4-triazol-3-yl)piperidin-1-yl]-methyl}phenyl)-1,6-naphthyridin-5(6H)-one; disclosed in WO2006065601; gamma secretase inhibitor 421B (U.S. Pat. No. 7,138,400 and WO02/36555); cMET inhibitors L-001501404 (4-(6-Phenyl-[1,2,4]triazolo[4,3-b][1,2,4]triazin-3-ylmethyl)-phenol, see also U.S. Pat. No. 7,122,548), MK-2461 (N-[(2R)-1,4-dioxan-2-ylmethyl]-N-methyl-N'-[3-(1-methyl-1H-pyrazol-4-yl)-5-oxo-5H-benzo[4,5]cyclohepta[1,2-b]pyridin-7-yl]sulfamide), and L-001793225 (1-[3-(1-Methyl-1H-pyrazol-4-yl)-5-oxo-5H-benzo[4,5] cyclohepta[1,2-b]pyridin-7-yl]-N-(pyridin-2-ylmethyl) methanesulfonamide.

In one embodiment, the method for measuring the effect or determining whether an agent modulates the growth factor signaling pathway comprises: (1) comparing the level of expression of the biomarkers listed in Table 5a and 5b in a sample treated with an agent to the level of expression of the same biomarkers in a standard or control, wherein the standard or control levels represent those found in a vehicle-treated sample; and (2) determining whether the level of the biomarker-related polynucleotides in the treated sample is significantly different than that of the vehicle-treated control, wherein if no substantial difference is found, the agent is predicted not to have an modulate the growth factor signaling pathway, and if a substantial difference is found, the agent is predicted to modulate the growth factor signaling pathway. In a more specific embodiment, the invention provides a subset of at least 5, 10, 20, 30, 40, 50, 75, or 100 biomarkers, drawn from the set of 101 that can be used to measure or determine the effect of an agent on the growth factor signaling pathway. Alternatively, the fullest set of 86 biomarkers from Table 11 may be used or a subset of at least 5, 10, 20, 30, 40, 50, 60, 70, or 75 of the 86 biomarkers maybe used.

In another embodiment, the above method of measuring the effect of an agent on the growth factor signaling pathway uses the two "arms" of the 101 biomarkers. The "up" arm comprises the genes whose expression goes up with growth factor pathway activation (see Table 5a), and the "down" arm comprises the genes whose expression goes down with growth factor pathway activation (see Table 5b). Alternatively, the "up" arm comprises genes from Table 11 whose expression goes up with growth factor pathway activation, and the "down" arm comprises genes from Table 11 whose expression goes down with growth factor pathway activation. When comparing an individual sample with a standard or control, the expression value of gene X in the sample is compared to the expression value of gene X in the standard or control. For each gene in the set of biomarkers, a log(10) ratio is created for the expression value in the individual sample relative to the standard or control. A signature "score" is calculated by determining the mean log(10) ratio of the genes in the "up" arm and the subtracting the mean log(10) ratio of the genes in the "down" arm. If the signature score is above a pre-determined threshold, then the sample is considered to have deregulation of the growth factor signaling pathway (i.e., the agent modulates the growth factor signaling pathway). The pre-determined threshold may be 0, or may be the mean, median, or a percentile of signature scores of a collection of samples or a pooled sample used as a standard or control. To determine if this signature score is significant, an ANOVA calculation is performed (for example, a two tailed t-test, Wilcoxon rank-sum test, Kolmogorov-Smirnov test, etc.), in which the expression values of the genes in the two opposing arms are compared to one another. For example, if the two tailed t-test is used to determine whether the mean log(10) ratio of the genes in the "up" arm is significantly different than the mean log(10) ratio of the genes in the "down" arm, a p-value of <0.05 indicates that the signature in the individual sample is significantly different from the standard or control. Alternatively, a subset of at least 3, 5, 10, 15, 20, 25, 30, 35, 40, 45, 50, 55 or 60 biomarkers, drawn from the "up" arm (see Table 5a) and a subset of at least 3, 5, 10, 15, 20, 25, 30, or 35 biomarkers from the "down" arm (see Table 5b) may be used for calculating this signature score. In yet another embodiment, a subset of at least 3, 5, 10, 15, 20, 25, 30, 35, or 40 biomarkers, drawn from the "up" arm (see Table 11), and a subset of at least 3, 5, 10, 15, 20, 25, 30, 35, or 40 biomarkers, drawn from the "down" arm (see Table 11), may be used for calculating this signature score. It will be recognized by those skilled in the art that other differential expression values, besides log(10) ratio may be used for calculating a signature score, as long as the value represents an objective measurement of transcript abundance of the biomarker gene. Examples include, but are not limited to: xdev, error-weighted log (ratio), and mean subtracted log(intensity).

The above described methods of using the biomarker sets may also be used to analyze a sample from an individual so as to determine whether an agent modulates the glycolysis pathway, using the set of biomarkers listed in Table 13. The full set or a subset of at least 5, 10, 15, 20, 25, 30, or 35 of the 39 biomarkers in Table 13 may be utilized.

The term "glycolysis pathway" or "glycolytic pathway" refers to the oxygen-independent cellular energy production pathway that breaks down one molecule of glucose into 2 molecules of pyruvate, resulting in the production of 2 ATP. Pyruvate is then reduced to lactate in the glycolysis pathway. In the presence of oxygen, pyruvate is oxidized to $HCO_3$, generating 36 additional ATP per glucose (oxidative phosphorylation pathway). Conversion of glucose to lactic acid in the presence of oxygen is also called "aerobic glycolysis" or the "Warburg effect." Increased glycolysis in the presence of oxygen is a hallmark of primary and metastatic cancers (reviewed in Gatenby and Gillies, 2004, Nature Reviews Cancer 4:891-899; Lopez-Lazaro, 2008, Anti-Cancer Agents in Med. Chem., 8:305-312; Kondoh, 2008, Exp. Cell Res. 314:1923-1928).

Agents affecting the glycolysis pathway include small molecule compounds; proteins or peptides (including antibodies); siRNA, shRNA, or microRNA molecules; or any other agents that modulate one or more genes or proteins that function within the glycolysis pathway or other pathways that interact with the glycolysis pathway.

"Glycolysis pathway agent" refers to an agent which modulates the glycolysis pathway. A glycolysis inhibitor inhibits the glycolysis pathway. Molecular targets of such inhibitors include, but are not limited to, hexokinase, phosphofructokinase, pyruvate kinase, glucose transporters, Such agents are well known in the art and include, but are not limited to: lonidamine, 3-bromopyruvate, 2-deoxyglucose, imatinib, ATP citrate lyase inhibitor SB-204990, oxythiamine, genistein, 5-thioglucose, mannoheptulose, α-chlorohydrin, ornidazole, glufosfamide, arsenic compounds, oxamate, iodoacetate, bisphosphonates, tubercidin, and $Na^+/K^+$-ATPase pump inhibitors, GLUT inhibitors, 3-(3-pyridinyl)-1-(4-pyridinyl)-2-propen-1-one, dichloroacetate (reviewed in Lopez-Lazaro, 2008, Anti-Cancer Agents in Medicinal Chemistry 8:305-312; Clem et al., 2008, Mol. Cancer Ther. 7:110-120; Bonnet et al., 2007, Cancer Cell 11:37-51).

The above described methods of using the biomarker sets may also be used to rank order agents according to their effect on the biomarker sets or subsets. For example, agents may be ranked according to the change induced in differential expression value (for example, mean expression value of the biomarker set or subset or signature score) in the biomarker set or subsets. Candidate agents may also be ranked by comparison with agents known to modify the particular pathway in question.

3.4.4 Method of Measuring Pharmacodynamic Effect of an Agent

The invention provides a set of biomarkers useful for measuring the pharmacodynamic effect of an agent on the growth factor signaling pathway. The biomarkers provided may be used to monitor modulation of the growth factor signaling pathway at various time points following treatment with said agent in a patient or sample. Thus, the invention further provides a method for using these biomarkers as an early evaluation for efficacy of an agent which modulates the growth factor signaling pathway. In one embodiment, the invention provides for a method of measuring pharmacodynamic effect of an agent that modulates the growth factor signaling pathway in patient or sample comprising: (1) comparing the level of expression of the biomarkers listed in Table 5a and 5b in a sample treated with an agent to the level of expression of the same biomarkers in a standard or control, wherein the standard or control levels represent those found in a vehicle-treated sample; and (2) determining whether the level of the biomarker-related polynucleotides in the treated sample is significantly different than that of the vehicle-treated control, wherein if no substantial difference is found, the agent is predicted not to have an pharmacodynamic effect on the growth factor signaling pathway, and if a substantial difference is found, the agent is predicted to have an pharmacodynamic effect on the growth factor signaling pathway. In a more specific embodiment, the invention provides a subset of at least 5, 10, 20, 30, 40, 50, 75, or 100 biomarkers, drawn from the set of 101 that can be used to monitor pharmacodynamic activity of an agent on the growth factor signaling pathway. In yet another embodiment, the set of 86 biomarkers listed in Table 11 may be used to monitor pharmacodynamic activity of an agent on the growth factor signaling pathway, or a subset of at least 5, 10, 20, 30, 40, 50, 60, 70, or 80 biomarkers, drawn from the set of 86, may be used.

In another embodiment, the above method of measuring pharmacodynamic activity of an agent on the growth factor signaling pathway uses the two "arms" of the 101 biomarkers. The "up" arm comprises the genes whose expression goes up with growth factor pathway activation (see Table 5a), and the "down" arm comprises the genes whose expression goes down with growth factor pathway activation (see Table 5b). Alternatively, the above method of measuring pharmacodynamic activity uses the two "arms" of the 86 biomarkers listed in Table 11. The "up" arm comprising 44 genes (see Table 11) and the "down" arm comprising 42 genes (see Table 11). When comparing an individual sample with a standard or control, the expression value of gene X in the sample is compared to the expression value of gene X in the standard or control. For each gene in the set of biomarkers, a log(10) ratio is created for the expression value in the individual sample relative to the standard or control. A signature "score" is calculated by determining the mean log(10) ratio of the genes in the "up" arm and the subtracting the mean log(10) ratio of the genes in the "down" arm. If the signature score is above a pre-determined threshold, then the sample is considered to have deregulation of the growth factor signaling pathway. The pre-determined threshold may be 0, or may be the mean, median, or a percentile of signature scores of a collection of samples or a pooled sample used as a standard or control. To determine if this signature score is significant, an ANOVA calculation is performed (for example, a two tailed t-test, Wilcoxon rank-sum test, Kolmogorov-Smirnov test, etc.), in which the expression values of the genes in the two opposing arms are compared to one another. For example, if the two tailed t-test is used to determine whether the mean log(10) ratio of the genes in the "up" arm is significantly different than the mean log(10) ratio of the genes in the "down" arm, a p-value of <0.05 indicates that the signature in the individual sample is significantly different from the standard or control. Alternatively, a subset of at least 3, 5, 10, 15, 20, 25, 30, 35, 40, 45, 50, 55 or 60 biomarkers, drawn from the "up" arm (see Table 5a) and a subset of at least 3, 5, 10, 15, 20, 25, 30, or 35 biomarkers from the "down" arm (see Table 5b) may be used for calculating this signature score. In yet another embodiment, a subset of at least 3, 5, 10, 15, 20, 25, 30, 35, or 40 biomarkers, drawn from the "up" arm (see Table 11) and a subset of at least 3, 5, 10, 15, 20, 25, 30, 35, or 40 biomarkers drawn from the "down" arm (see Table 11) may be used for calculating this signature score. It will be recognized by those skilled in the art that other differential expression values, besides log(10) ratio may be used for calculating a signature score, as long as the value represents an objective measurement of transcript abundance of the biomarker gene. Examples include, but are not limited to: xdev, error-weighted log (ratio), and mean subtracted log(intensity).

The above described methods of using the biomarker sets may also be used to analyze a sample from an individual so as to measure pharmacodynamic effect of an agent on the glycolysis pathway, using the set of biomarkers listed in Table 13. The full set or a subset of the 39 biomarkers in Table 13 may be utilized.

The use of the biomarkers is not restricted to measure the pharmacodynamic effect of an agent on the growth factor signaling pathway for cancer-related conditions, and may be applied in a variety of phenotypes or conditions, clinical or experimental, in which gene expression plays a role. Where a set of biomarkers has been identified that corresponds to two or more phenotypes, the biomarker sets can be used to distinguish these phenotypes. For example, the phenotypes may be the diagnosis and/or prognosis of clinical states or phenotypes associated with cancers and other disease conditions, or other physiological conditions, prediction of response to agents that modulate pathways other than the growth factor signaling pathway, wherein the expression level data is derived from a set of genes correlated with the particular physiological or disease condition.

3.4.5 Improving Sensitivity to Expression Level Differences

In using the biomarkers disclosed herein, and, indeed, using any sets of biomarkers to differentiate an individual or subject having one phenotype from another individual or subject having a second phenotype, one can compare the absolute expression of each of the biomarkers in a sample to a control; for example, the control can be the average level of expression of each of the biomarkers, respectively, in a pool of individuals or subjects. To increase the sensitivity of the comparison, however, the expression level values are preferably transformed in a number of ways.

For example, the expression level of each of the biomarkers can be normalized by the average expression level of all markers the expression level of which is determined, or by the average expression level of a set of control genes. Thus, in one embodiment, the biomarkers are represented by probes on a microarray, and the expression level of each of the biomarkers is normalized by the mean or median expression level across all of the genes represented on the microarray, including any non-biomarker genes. In a specific embodiment, the normalization is carried out by dividing the median or mean level of expression of all of the genes on the microarray. In another embodiment, the expression levels of the biomarkers is normalized by the mean or median level of expression of a set of control biomarkers. In a specific embodiment, the control biomarkers comprise a set of housekeeping genes. In another specific embodiment, the normalization is accomplished by dividing by the median or mean expression level of the control genes.

The sensitivity of a biomarker-based assay will also be increased if the expression levels of individual biomarkers are compared to the expression of the same biomarkers in a pool of samples. Preferably, the comparison is to the mean or median expression level of each the biomarker genes in the pool of samples. Such a comparison may be accomplished, for example, by dividing by the mean or median expression level of the pool for each of the biomarkers from the expression level each of the biomarkers in the sample. This has the effect of accentuating the relative differences in expression between biomarkers in the sample and markers in the pool as a whole, making comparisons more sensitive and more likely to produce meaningful results that the use of absolute expression levels alone. The expression level data may be transformed in any convenient way; preferably, the expression level data for all is log transformed before means or medians are taken.

In performing comparisons to a pool, two approaches may be used. First, the expression levels of the markers in the sample may be compared to the expression level of those markers in the pool, where nucleic acid derived from the sample and nucleic acid derived from the pool are hybridized during the course of a single experiment. Such an approach requires that new pool nucleic acid be generated for each comparison or limited numbers of comparisons, and is therefore limited by the amount of nucleic acid available. Alternatively, and preferably, the expression levels in a pool, whether normalized and/or transformed or not, are stored on a computer, or on computer-readable media, to be used in comparisons to the individual expression level data from the sample (i.e., single-channel data).

Thus, the current invention provides the following method of classifying a first cell or organism as having one of at least two different phenotypes, where the different phenotypes comprise a first phenotype and a second phenotype. The level of expression of each of a plurality of genes in a first sample from the first cell or organism is compared to the level of expression of each of said genes, respectively, in a pooled sample from a plurality of cells or organisms, the plurality of cells or organisms comprising different cells or organisms exhibiting said at least two different phenotypes, respectively, to produce a first compared value. The first compared value is then compared to a second compared value, wherein said second compared value is the product of a method comprising comparing the level of expression of each of said genes in a sample from a cell or organism characterized as having said first phenotype to the level of expression of each of said genes, respectively, in the pooled sample. The first compared value is then compared to a third compared value, wherein said third compared value is the product of a method comprising comparing the level of expression of each of the genes in a sample from a cell or organism characterized as having the second phenotype to the level of expression of each of the genes, respectively, in the pooled sample. Optionally, the first compared value can be compared to additional compared values, respectively, where each additional compared value is the product of a method comprising comparing the level of expression of each of said genes in a sample from a cell or organism characterized as having a phenotype different from said first and second phenotypes but included among the at least two different phenotypes, to the level of expression of each of said genes, respectively, in said pooled sample. Finally, a determination is made as to which of said second, third, and, if present, one or more additional compared values, said first compared value is most similar, wherein the first cell or organism is determined to have the phenotype of the cell or organism used to produce said compared value most similar to said first compared value.

In a specific embodiment of this method, the compared values are each ratios of the levels of expression of each of said genes. In another specific embodiment, each of the levels of expression of each of the genes in the pooled sample are normalized prior to any of the comparing steps. In a more specific embodiment, the normalization of the levels of expression is carried out by dividing by the median or mean level of the expression of each of the genes or dividing by the mean or median level of expression of one or more housekeeping genes in the pooled sample from said cell or organism. In another specific embodiment, the normalized levels of expression are subjected to a log transform, and the comparing steps comprise subtracting the log transform from the log of the levels of expression of each of the genes in the sample. In another specific embodiment, the two or more different phenotypes are different regulation status of the growth factor signaling pathway. In still another specific embodiment, the two or more different phenotypes are different predicted responses to treatment with an agent that modulates the growth factor signaling pathway. In yet another specific embodiment, the levels of expression of each of the genes, respectively, in the pooled sample or said levels of expression of each of said genes in a sample from the cell or organism characterized as having the first phenotype, second phenotype, or said phenotype different from said first and second phenotypes, respectively, are stored on a computer or on a computer-readable medium.

In another specific embodiment, the two phenotypes are deregulated or regulated growth factor signaling pathway status. In another specific embodiment, the two phenotypes are predicted growth factor signaling pathway-agent responder status. In yet another specific embodiment, the two phenotypes are pharmacodynamic effect and no pharmacodynamic effect of an agent on the growth factor signaling pathway.

In another specific embodiment, the two phenotypes are activated or non-activated glycolysis pathway status. In another specific embodiment, the two phenotypes are predicted glycolysis pathway-agent responder status. In yet another specific embodiment, the two phenotypes are pharmacodynamic effect and no pharmacodynamic effect of an agent on the glycolysis pathway.

In another specific embodiment, the comparison is made between the expression of each of the genes in the sample and the expression of the same genes in a pool representing only one of two or more phenotypes. In the context of growth factor signaling pathway status-correlated genes, for example, one can compare the expression levels of growth factor signaling pathway regulation status-related genes in a sample to the average level of the expression of the same genes in a "deregulated" pool of samples (as opposed to a pool of samples that include samples from patients having regulated and deregulated growth factor signaling pathway status). Thus, in this method, a sample is classified as having a deregulated growth factor signaling pathway status if the level of expression of prognosis-correlated genes exceeds a chosen coefficient of correlation to the average "deregulated growth factor signaling pathway" expression profile (i.e., the level of expression of growth factor signaling pathway status-correlated genes in a pool of samples from patients having a "deregulated growth factor signaling pathway status." Patients or subjects whose expression levels correlate more poorly with the "deregulated growth factor signaling pathway" expression profile (i.e., whose correlation coefficient fails to exceed the chosen coefficient) are classified as having a regulated growth factor signaling pathway status.

Of course, single-channel data may also be used without specific comparison to a mathematical sample pool. For example, a sample may be classified as having a first or a second phenotype, wherein the first and second phenotypes are related, by calculating the similarity between the expression of at least 5 markers in the sample, where the markers are correlated with the first or second phenotype, to the expression of the same markers in a first phenotype template and a second phenotype template, by (a) labeling nucleic acids derived from a sample with a fluorophore to obtain a pool of fluorophore-labeled nucleic acids; (b) contacting said fluorophore-labeled nucleic acid with a microarray under conditions such that hybridization can occur, detecting at each of a plurality of discrete loci on the microarray a fluorescent emission signal from said fluorophore-labeled nucleic acid that is bound to said microarray under said conditions; and (c) determining the similarity of marker gene expression in the individual sample to the first and second templates, wherein if said expression is more similar to the first template, the sample is classified as having the first phenotype, and if said expression is more similar to the second template, the sample is classified as having the second phenotype.

3.4.6 Methods for Classification of Expression Profiles

In preferred embodiments, the methods of the invention use a classifier for predicting growth factor signaling pathway regulation status of a sample, predicting response to agents that modulate the growth factor signaling pathway, assigning treatment to a subject, and/or measuring pharmacodynamic effect of an agent. The classifier can be based on any appropriate pattern recognition method that receives an input comprising a biomarker profile and provides an output comprising data indicating which patient subset the patient belongs. The classifier can be trained with training data from a training population of subjects. Typically, the training data comprise for each of the subjects in the training population a training marker profile comprising measurements of respective gene products of a plurality of genes in a suitable sample taken from the patient and outcome information, i.e., deregulated or regulated growth factor signaling pathway status.

In preferred embodiments, the classifier can be based on a classification (pattern recognition) method described below, e.g., profile similarity; artificial neural network); support vector machine (SVM); logic regression, linear or quadratic discriminant analysis, decision trees, clustering, principal component analysis, nearest neighbor classifier analysis (described infra). Such classifiers can be trained with the training population using methods described in the relevant sections, infra.

The biomarker profile can be obtained by measuring the plurality of gene products in a cell sample from the subject using a method known in the art, e.g., a method described infra.

Various known statistical pattern recognition methods can be used in conjunction with the present invention. A classifier based on any of such methods can be constructed using the biomarker profiles and growth factor pathway signalling status data of training patients. Such a classifier can then be used to evaluate the growth factor pathway signalling status of a patient based on the patient's biomarker profile. The methods can also be used to identify biomarkers that discriminate between different growth factor signalling pathway regulation status using a biomarker profile and growth factor signalling pathway regulation data of training patients.

A. Profile Matching

A subject can be classified by comparing a biomarker profile obtained in a suitable sample from the subject with a biomarker profile that is representative of a particular phenotypic state. Such a marker profile is also termed a "template profile" or a "template." The degree of similarity to such a template profile provides an evaluation of the subject's phenotype. If the degree of similarity of the subject marker profile and a template profile is above a predetermined threshold, the subject is assigned the classification represented by the template. For example, a subject's outcome prediction can be evaluated by comparing a biomarker profile of the subject to a predetermined template profile corresponding to a given phenotype or outcome, e.g., a growth factor signalling pathway template comprising measurements of the plurality of biomarkers which are representative of levels of the biomarkers in a plurality of subjects that have tumors with deregulated growth factor signalling pathway status.

In one embodiment, the similarity is represented by a correlation coefficient between the subject's profile and the template. In one embodiment, a correlation coefficient above a correlation threshold indicates a high similarity, whereas a correlation coefficient below the threshold indicates a low similarity.

In a specific embodiment, $P_1$ measures the similarity between the subject's profile $\vec{y}$ and a template profile comprising measurements of marker gene products representative of measurements of marker gene products in subjects having a particular outcome or phenotype, e.g., deregulated growth factor signalling pathway status $\vec{z}_1$ or a regulated growth factor signalling pathway status $\vec{z}_2$. Such a coefficient, $P_i$, can be calculated using the following equation:

$$P_i = (\vec{z}_i \cdot \vec{y})/(\|\vec{z}_i\| \cdot \|\vec{y}\|)$$

where i designates the ith template. Thus, in one embodiment, $\vec{y}$ is classified as a deregulated growth factor signalling pathway profile if $P_1$ is greater than a selected correlation threshold. In another embodiment, $\vec{y}$ is classified as a regulated growth factor signalling pathway profile if $P_2$ is greater than a selected correlation threshold. In preferred embodiments, the correlation threshold is set as 0.3, 0.4, 0.5 or 0.6. In another embodiment, $\vec{y}$ is classified as a deregulated growth factor signalling pathway profile if $P_1$ is greater than $P_2$, whereas $\vec{y}$ is classified as a regulated growth factor signalling pathway profile if $P_1$ is less than $P_2$.

In another embodiment, the correlation coefficient is a weighted dot product of the patient's profile $\vec{y}$ and a template profile, in which measurements of each different marker is assigned a weight.

In another embodiment, similarity between a patient's profile and a template is represented by a distance between the patient's profile and the template. In one embodiment, a distance below a given value indicates high similarity, whereas a distance equal to or greater than the given value indicates low similarity.

In one embodiment, the Euclidian distance according to the formula $$D_i = \|\vec{y} - \vec{z}_i\|$$

is used, where $D_i$ measures the distance between the subject's profile $\vec{y}$ and a template profile comprising measurements of marker gene products representative of measurements of marker gene products in subjects having a particular growth factor signaling pathway regulation status, e.g., the deregulated growth factor signaling pathway $\vec{z}_1$ or the regulated growth factor signaling pathway template $\vec{z}_2$. In other embodiments, the Euclidian distance is squared to place progressively greater weight on cellular constituents that are further apart. In alternative embodiments, the distance measure $D_i$ is the Manhattan distance provide by $$D_i = \sum_n |y(n) - z_i(n)|$$

where $y(n)$ and $z_i(n)$ are respectively measurements of the nth marker gene product in the subject's profile $\vec{y}$ and a template profile.

In another embodiment, the distance is defined as $D_i = 1 - P_i$, where $P_i$ is the correlation coefficient or normalized dot product as described above.

In still other embodiments, the distance measure may be the Chebychev distance, the power distance, and percent disagreement, all of which are well known in the art.

B. Artificial Neural Network

In some embodiments, a neural network is used. A neural network can be constructed for a selected set of molecular markers of the invention. A neural network is a two-stage regression or classification model. A neural network has a layered structure that includes a layer of input units (and the bias) connected by a layer of weights to a layer of output units. For regression, the layer of output units typically includes just one output unit. However, neural networks can handle multiple quantitative responses in a seamless fashion.

In multilayer neural networks, there are input units (input layer), hidden units (hidden layer), and output units (output layer). There is, furthermore, a single bias unit that is connected to each unit other than the input units. Neural networks are described in Duda et al., 2001, *Pattern Classification*, Second Edition, John Wiley & Sons, Inc., New York; and Hastie et al., 2001, *The Elements of Statistical Learning*, Springer-Verlag, New York.

The basic approach to the use of neural networks is to start with an untrained network, present a training pattern, e.g., biomarker profiles from training patients, to the input layer, and to pass signals through the net and determine the output, e.g., the growth factor signaling pathway regulation status in the training patients, at the output layer. These outputs are then compared to the target values; any difference corresponds to an error. This error or criterion function is some scalar function of the weights and is minimized when the network outputs match the desired outputs. Thus, the weights are adjusted to reduce this measure of error. For regression, this error can be sum-of-squared errors. For classification, this error can be either squared error or cross-entropy (deviation). See, e.g., Hastie et al., 2001, *The Elements of Statistical Learning*, Springer-Verlag, New York.

Three commonly used training protocols are stochastic, batch, and on-line. In stochastic training, patterns are chosen randomly from the training set and the network weights are updated for each pattern presentation. Multilayer nonlinear networks trained by gradient descent methods such as stochastic back-propagation perform a maximum-likelihood estimation of the weight values in the model defined by the network topology. In batch training, all patterns are presented to the network before learning takes place. Typically, in batch training, several passes are made through the training data. In online training, each pattern is presented once and only once to the net.

In some embodiments, consideration is given to starting values for weights. If the weights are near zero, then the operative part of the sigmoid commonly used in the hidden layer of a neural network (see, e.g., Hastie et al, 2001, *The Elements of Statistical Learning*, Springer-Verlag, New York) is roughly linear, and hence the neural network collapses into an approximately linear model. In some embodiments, starting values for weights are chosen to be random values near zero. Hence the model starts out nearly linear, and becomes nonlinear as the weights increase. Individual units localize to directions and introduce nonlinearities where needed. Use of exact zero weights leads to zero derivatives and perfect symmetry, and the algorithm never moves. Alternatively, starting with large weights often leads to poor solutions.

Since the scaling of inputs determines the effective scaling of weights in the bottom layer, it can have a large effect on the quality of the final solution. Thus, in some embodiments, at the outset all expression values are standardized to have mean zero and a standard deviation of one. This ensures all inputs are treated equally in the regularization process, and allows one to choose a meaningful range for the random starting weights. With standardization inputs, it is typical to take random uniform weights over the range [−0.7, +0.7].

A recurrent problem in the use of networks having a hidden layer is the optimal number of hidden units to use in the network. The number of inputs and outputs of a network are determined by the problem to be solved. In the present invention, the number of inputs for a given neural network can be the number of molecular markers in the selected set of molecular markers of the invention. The number of output for the neural network will typically be just one. However, in some embodiment more than one output is used so that more than just two states can be defined by the network. If too many hidden units are used in a neural network, the network will have too many degrees of freedom and is trained too long, there is a danger that the network will overfit the data. If there are too few hidden units, the training set cannot be learned. Generally speaking, however, it is better to have too many hidden units than too few. With too few hidden units, the model might not have enough flexibility to capture the nonlinearities in the data; with too many hidden units, the extra weight can be shrunk towards zero if appropriate regularization or pruning, as described below, is used. In typical embodiments, the number of hidden units is somewhere in the range of 5 to 100, with the number increasing with the number of inputs and number of training cases.

One general approach to determining the number of hidden units to use is to apply a regularization approach. In the regularization approach, a new criterion function is constructed that depends not only on the classical training error, but also on classifier complexity. Specifically, the new criterion function penalizes highly complex models; searching for the minimum in this criterion is to balance error on the training set with error on the training set plus a regularization term, which expresses constraints or desirable properties of solutions:

$$J = J_{pat} + \lambda J_{reg}.$$

The parameter $\lambda$ is adjusted to impose the regularization more or less strongly. In other words, larger values for $\lambda$ will tend to shrink weights towards zero: typically cross-validation with a validation set is used to estimate $\lambda$. This validation set can be obtained by setting aside a random subset of the training population. Other forms of penalty can also be used, for example the weight elimination penalty (see, e.g., Hastie et al., 2001, *The Elements of Statistical Learning*, Springer-Verlag, New York).

Another approach to determine the number of hidden units to use is to eliminate—prune—weights that are least needed. In one approach, the weights with the smallest magnitude are eliminated (set to zero). Such magnitude-based pruning can work, but is nonoptimal; sometimes weights with small magnitudes are important for learning and training data. In some embodiments, rather than using a magnitude-based pruning approach, Wald statistics are computed. The fundamental idea in Wald Statistics is that they can be used to estimate the importance of a hidden unit (weight) in a model. Then, hidden units having the least importance are eliminated (by setting their input and output weights to zero). Two algorithms in this regard are the Optimal Brain Damage (OBD) and the Optimal Brain Surgeon (OBS) algorithms that use second-order approximation to predict how the training error depends upon a weight, and eliminate the weight that leads to the smallest increase in training error.

Optimal Brain Damage and Optimal Brain Surgeon share the same basic approach of training a network to local minimum error at weight w, and then pruning a weight that leads to the smallest increase in the training error. The predicted functional increase in the error for a change in full weight vector $\delta w$ is:

$$\delta J = \left(\frac{\partial J}{\partial w}\right)' \cdot \delta w + \frac{1}{2} \delta w' \cdot \frac{\partial^2 J}{\partial w^2} \cdot \delta w + O(\|\delta w\|^3)$$

where $$\frac{\partial^2 J}{\partial w^2}$$

is the Hessian matrix. The first term vanishes because we are at a local minimum in error; third and higher order terms are ignored. The general solution for minimizing this function given the constraint of deleting one weight is:

$$\delta w = -\frac{w_q}{[H^{-1}]_{qq}} H^{-1} \cdot u_q \text{ and } L_q = \frac{1}{2} \cdot \frac{w_q^2}{[H^{-1}]_{qq}}$$

Here, $u_q$ is the unit vector along the qth direction in weight space and $L_q$ is approximation to the saliency of the weight q—the increase in training error if weight q is pruned and the other weights updated $\delta w$. These equations require the inverse of H. One method to calculate this inverse matrix is to start with a small value, $H_0^{-1} = \alpha^{-1} I$, where $\alpha$ is a small parameter—effectively a weight constant. Next the matrix is updated with each pattern according to $$H_{m+1}^{-1} = H_m^{-1} - \frac{H_m^{-1} X_{m+1} X_{m+1}^T H_m^{-1}}{\frac{n}{a_m} + X_{m+1}^T H_m^{-1} X_{m+1}}$$

where the subscripts correspond to the pattern being presented and $\alpha_m$ decreases with m. After the full training set has been presented, the inverse Hessian matrix is given by $H^{-1} = H_n^{-1}$. In algorithmic form, the Optimal Brain Surgeon method is:

```
begin initialize n_H, w, θ
    train a reasonably large network to minimum error
    do compute H^-1 by Eqn. 1
        q* ← arg min w_q^2/(2[H^-1]_qq) (saliency L_q)
                 q
        w ← w - ────w_q*──── H^-1 e_q* (saliency L_q)
                [H^-1]_q*q*
    until J(w) > θ
    return w
end
```

The Optimal Brain Damage method is computationally simpler because the calculation of the inverse Hessian matrix in line 3 is particularly simple for a diagonal matrix. The above algorithm terminates when the error is greater than a criterion initialized to be θ. Another approach is to change line 6 to terminate when the change in J(w) due to elimination of a weight is greater than some criterion value.

In some embodiments, a back-propagation neural network (see, for example Abdi, 1994, "A neural network primer", J. Biol System. 2, 247-283) containing a single hidden layer of ten neurons (ten hidden units) found in EasyNN-Plus version 4.0 g software package (Neural Planner Software Inc.) is used. In a specific example, parameter values within the EasyNN-Plus program are set as follows: a learning rate of 0.05, and a momentum of 0.2. In some embodiments in which the EasyNN-Plus version 4.0 g software package is used, "outlier" samples are identified by performing twenty independently-seeded trials involving 20,000 learning cycles each.

C. Support Vector Machine

In some embodiments of the present invention, support vector machines (SVMs) are used to classify subjects using expression profiles of marker genes described in the present invention. General description of SVM can be found in, for example, Cristianini and Shawe-Taylor, 2000, *An Introduction to Support Vector Machines*, Cambridge University Press, Cambridge, Boser et al., 1992, "A training algorithm for optimal margin classifiers, in *Proceedings of the 5th Annual ACM Workshop on Computational Learning Theory*, ACM Press, Pittsburgh, Pa., pp. 142-152; Vapnik, 1998, *Statistical Learning Theory*, Wiley, New York; Duda, *Pattern Classification*, Second Edition, 2001, John Wiley & Sons, Inc.; Hastie, 2001, *The Elements of Statistical Learning*, Springer, N.Y.; and Furey et al., 2000, Bioinformatics 16, 906-914. Applications of SVM in biological applications are described in Jaakkola et al., *Proceedings of the 7th International Conference on Intelligent Systems for Molecular Biology*, AAAI Press, Menlo Park, Calif. (1999); Brown et al., *Proc. Natl. Acad. Sci.* 97(1):262-67 (2000); Zien et al., *Bioinformatics*, 16(9):799-807 (2000); Furey et al., *Bioinformatics*, 16(10:906-914 (2000)

In one approach, when a SVM is used, the gene expression data is standardized to have mean zero and unit variance and the members of a training population are randomly divided into a training set and a test set. For example, in one embodiment, two thirds of the members of the training population are placed in the training set and one third of the members of the training population are placed in the test set. The expression values for a selected set of genes of the present invention is used to train the SVM. Then the ability for the trained SVM to correctly classify members in the test set is determined. In some embodiments, this computation is performed several times for a given selected set of molecular markers. In each iteration of the computation, the members of the training population are randomly assigned to the training set and the test set. Then, the quality of the combination of molecular markers is taken as the average of each such iteration of the SVM computation.

Support vector machines map a given set of binary labeled training data to a high-dimensional feature space and separate the two classes of data with a maximum margin hyperplane. In general, this hyperplane corresponds to a nonlinear decision boundary in the input space. Let $X \in R_0 \subset \Re^n$ be the input vectors, $y \in \{-1, +1\}$ be the labels, and $\phi: R_0 \to F$ be the mapping from input space to feature space. Then the SVM learning algorithm finds a hyperplane (w,b) such that the quantity $$\gamma = \min_i y_i \{\langle w, \phi(X_i) \rangle - b\}$$

is maximized, where the vector w has the same dimensionality as F, b is a real number, and $\gamma$ is called the margin. The corresponding decision function is then $$f(X) = \text{sign}(\langle w, \phi(X) \rangle - b)$$

This minimum occurs when $$w = \sum_i \alpha_i y_i \phi(X_i)$$

where $\{\alpha_i\}$ are positive real numbers that maximize $$\sum_i \alpha_i - \sum_{ij} \alpha_i \alpha_j y_i y_j \langle \phi(X_i), \phi(X_j) \rangle$$

subject to $$\sum_i \alpha_i y_i = 0, \alpha_i > 0$$

The decision function can equivalently be expressed as $$f(X) = \text{sign}\left(\sum_i \alpha_i y_i \langle \phi(X_i), \phi(X) \rangle - b\right)$$

From this equation it can be seen that the $\alpha_i$ associated with the training point $X_i$ expresses the strength with which that point is embedded in the final decision function. A remarkable property of this alternative representation is that only a subset of the points will be associated with a non-zero $\alpha_i$. These points are called support vectors and are the points that lie closest to the separating hyperplane. The sparseness of the α vector has several computational and learning theoretic consequences. It is important to note that neither the learning algorithm nor the decision function needs to represent explicitly the image of points in the feature space, $\phi(X_i)$, since both use only the dot products between such images, $\langle \phi(X_i), \phi(X_j) \rangle$. Hence, if one were given a function $K(X,Y) = \langle \phi(X), \phi(X) \rangle$, one could learn and use the maximum margin hyperplane in the feature space without ever explicitly performing the mapping. For each continuous positive definite function $K(X, Y)$ there exists a mapping $\phi$ such that $K(X, Y) = \langle \phi(X), \phi(X) \rangle$ for all $X, Y \in R_0$ (Mercer's Theorem). The function $K(X, Y)$ is called the kernel function. The use of a kernel function allows the support vector machine to operate efficiently in a nonlinear high-dimensional feature spaces without being adversely affected by the dimensionality of that space. Indeed, it is possible to work with feature spaces of infinite dimension. Moreover, Mercer's theorem makes it possible to learn in the feature space without even knowing $\phi$ and F. The matrix $K_{ij} = \langle \phi(X_i), \phi(X_j) \rangle$ is called the kernel matrix. Finally, note that the learning algorithm is a quadratic optimization problem that has only a global optimum. The absence of local minima is a significant difference from standard pattern recognition techniques such as neural networks. For moderate sample sizes, the optimization problem can be solved with simple gradient descent techniques. In the presence of noise, the standard maximum margin algorithm described above can be subject to overfitting, and more sophisticated techniques should be used. This problem arises because the maximum margin algorithm always finds a perfectly consistent hypothesis and does not tolerate training error. Sometimes, however, it is necessary to trade some training accuracy for better predictive power. The need for tolerating training error has led to the development the soft-margin and the margin-distribution classifiers. One of these techniques replaces the kernel matrix in the training phase as follows:

$$K \leftarrow K + \lambda I$$

while still using the standard kernel function in the decision phase. By tuning $\lambda$, one can control the training error, and it is possible to prove that the risk of misclassifying unseen points can be decreased with a suitable choice of $\lambda$.

If instead of controlling the overall training error one wants to control the trade-off between false positives and false negatives, it is possible to modify K as follows:

$$K \leftarrow K + \lambda D$$

where D is a diagonal matrix whose entries are either $d^+$ or $d^-$, in locations corresponding to positive and negative examples. It is possible to prove that this technique is equivalent to controlling the size of the $\alpha_i$ in a way that depends on the size of the class, introducing a bias for larger $\alpha_i$ in the class with smaller d. This in turn corresponds to an asymmetric margin; i.e., the class with smaller d will be kept further away from the decision boundary. In some cases, the extreme imbalance of the two classes, along with the presence of noise, creates a situation in which points from the minority class can be easily mistaken for mislabelled points. Enforcing a strong bias against training errors in the minority class provides protection against such errors and forces the SVM to make the positive examples support vectors. Thus, choosing $$d^+ = \frac{1}{n^+} \text{ and } d^- = \frac{1}{n^-}$$

provides a heuristic way to automatically adjust the relative importance of the two classes, based on their respective cardinalities. This technique effectively controls the trade-off between sensitivity and specificity.

In the present invention, a linear kernel can be used. The similarity between two marker profiles X and Y can be the dot product X·Y. In one embodiment, the kernel is $$K(X,Y) = X \cdot Y + 1$$

In another embodiment, a kernel of degree d is used $$K(X,Y) = (X \cdot Y + 1)^d, \text{ where d can be either 2, 3, ...}$$

In still another embodiment, a Gaussian kernel is used $$K(X, Y) = \exp\left(\frac{-|X-Y|^2}{2\sigma^2}\right)$$

where σ is the width of the Gaussian.

D. Logistic Regression

In some embodiments, the classifier is based on a regression model, preferably a logistic regression model. Such a regression model includes a coefficient for each of the molecular markers in a selected set of molecular biomarkers of the invention. In such embodiments, the coefficients for the regression model are computed using, for example, a maximum likelihood approach. In particular embodiments, molecular biomarker data from two different classification or phenotype groups, e.g., deregulated or regulated growth factor signaling pathway, response or non-response to treatment to an agent that modulates the growth factor signaling pathway, is used and the dependent variable is the phenotypic status of the patient for which molecular marker characteristic data are from.

Some embodiments of the present invention provide generalizations of the logistic regression model that handle multicategory (polychotomous) responses. Such embodiments can be used to discriminate an organism into one or three or more classification groups, e.g., good, intermediate, and poor therapeutic response to treatment with growth factor signaling pathway agents. Such regression models use multicategory logit models that simultaneously refer to all pairs of categories, and describe the odds of response in one category instead of another. Once the model specifies logits for a certain (J-1) pairs of categories, the rest are redundant. See, for example, Agresti, *An Introduction to Categorical Data Analysis*, John Wiley & Sons, Inc., 1996, New York, Chapter 8, which is hereby incorporated by reference.

E. Discriminant Analysis

Linear discriminant analysis (LDA) attempts to classify a subject into one of two categories based on certain object properties. In other words, LDA tests whether object attributes measured in an experiment predict categorization of the objects. LDA typically requires continuous independent variables and a dichotomous categorical dependent variable. In the present invention, the expression values for the selected set of molecular markers of the invention across a subset of the training population serve as the requisite continuous independent variables. The clinical group classification of each of the members of the training population serves as the dichotomous categorical dependent variable.

LDA seeks the linear combination of variables that maximizes the ratio of between-group variance and within-group variance by using the grouping information. Implicitly, the linear weights used by LDA depend on how the expression of a molecular biomarker across the training set separates in the two groups (e.g., a group that has deregulated growth factor signaling pathway and a group that have regulated growth factor signaling pathway status) and how this gene expression correlates with the expression of other genes. In some embodiments, LDA is applied to the data matrix of the N members in the training sample by K genes in a combination of genes described in the present invention. Then, the linear discriminant of each member of the training population is plotted. Ideally, those members of the training population representing a first subgroup (e.g. those subjects that have deregulated growth factor signaling pathway status) will cluster into one range of linear discriminant values (e.g., negative) and those member of the training population representing a second subgroup (e.g. those subjects that have regulated growth factor signaling pathway status) will cluster into a second range of linear discriminant values (e.g., positive). The LDA is considered more successful when the separation between the clusters of discriminant values is larger. For more information on linear discriminant analysis, see Duda, *Pattern Classification*, Second Edition, 2001, John Wiley & Sons, Inc; and Hastie, 2001, *The Elements of Statistical Learning*, Springer, N.Y.; Venables & Ripley, 1997, *Modern Applied Statistics with s-plus*, Springer, N.Y.

Quadratic discriminant analysis (QDA) takes the same input parameters and returns the same results as LDA. QDA uses quadratic equations, rather than linear equations, to produce results. LDA and QDA are interchangeable, and which to use is a matter of preference and/or availability of software to support the analysis. Logistic regression takes the same input parameters and returns the same results as LDA and QDA.

F. Decision Trees

In some embodiments of the present invention, decision trees are used to classify subjects using expression data for a selected set of molecular biomarkers of the invention. Decision tree algorithms belong to the class of supervised learning algorithms. The aim of a decision tree is to induce a classifier (a tree) from real-world example data. This tree can be used to classify unseen examples which have not been used to derive the decision tree.

A decision tree is derived from training data. An example contains values for the different attributes and what class the example belongs. In one embodiment, the training data is expression data for a combination of genes described in the present invention across the training population.

The following algorithm describes a decision tree derivation:

---

Tree (Examples, Class, Attributes)
    Create a root node
    If all Examples have the same Class value, give the root this label
    Else if Attributes is empty label the root according to the most
common value
    Else begin
        Calculate the information gain for each attribute
        Select the attribute A with highest information gain and make
this the root attribute
        For each possible value, v, of this attribute
            Add a new branch below the root, corresponding to A = v
            Let Examples(v) be those examples with A = v
            If Examples(v) is empty, make the new branch a leaf node
            labeled with the
                most common value among Examples
            Else let the new branch be the tree created by
                Tree(Examples(v),Class,Attributes - {A})
    end

---

A more detailed description of the calculation of information gain is shown in the following. If the possible classes $v_i$ of the examples have probabilities $P(v_i)$ then the information content I of the actual answer is given by:

$$I(P(v_1), \ldots, P(v_n)) = \sum_{i=1}^{n} -P(v_i)\log_2 P(v_i)$$

The I-value shows how much information we need in order to be able to describe the outcome of a classification for the specific dataset used. Supposing that the dataset contains p positive and n negative (examples (e.g. individuals), the information contained in a correct answer is:

$$I\left(\frac{p}{p+n}, \frac{n}{p+n}\right) = -\frac{p}{p+n}\log_2\frac{p}{p+n} - \frac{n}{p+n}\log_2\frac{n}{p+n}$$

where $\log_2$ is the logarithm using base two. By testing single attributes the amount of information needed to make a correct classification can be reduced. The remainder for a specific attribute A (e.g. a gene biomarker) shows how much the information that is needed can be reduced.

$$\text{Remainder}(A) = \sum_{i=1}^{v} \frac{p_i + n_i}{p+n} I\left(\frac{p_i}{p_i + n_i}, \frac{n_i}{p_i + n_i}\right)$$

"v" is the number of unique attribute values for attribute A in a certain dataset, "i" is a certain attribute value, "$p_i$" is the number of examples for attribute A where the classification is positive, "$n_i$" is the number of examples for attribute A where the classification is negative.

The information gain of a specific attribute A is calculated as the difference between the information content for the classes and the remainder of attribute A:

$$\text{Gain}(A) = I\left(\frac{p}{p+n}, \frac{n}{p+n}\right) - \text{Remainder}(A)$$

The information gain is used to evaluate how important the different attributes are for the classification (how well they split up the examples), and the attribute with the highest information.

In general there are a number of different decision tree algorithms, many of which are described in Duda, *Pattern Classification*, Second Edition, 2001, John Wiley & Sons, Inc. Decision tree algorithms often require consideration of feature processing, impurity measure, stopping criterion, and pruning. Specific decision tree algorithms include, cut are not limited to classification and regression trees (CART), multivariate decision trees, ID3, and C4.5.

In one approach, when an exemplary embodiment of a decision tree is used, the gene expression data for a selected set of molecular markers of the invention across a training population is standardized to have mean zero and unit variance. The members of the training population are randomly divided into a training set and a test set. For example, in one embodiment, two thirds of the members of the training population are placed in the training set and one third of the members of the training population are placed in the test set. The expression values for a select combination of genes described in the present invention is used to construct the decision tree. Then, the ability for the decision tree to correctly classify members in the test set is determined. In some embodiments, this computation is performed several times for a given combination of molecular markers. In each iteration of the computation, the members of the training population are randomly assigned to the training set and the test set. Then, the quality of the combination of molecular markers is taken as the average of each such iteration of the decision tree computation.

G. Clustering

In some embodiments, the expression values for a selected set of molecular markers of the invention are used to cluster a training set. For example, consider the case in which ten gene biomarkers described in one of the genesets of the present invention are used. Each member m of the training population will have expression values for each of the ten biomarkers. Such values from a member m in the training population define the vector:

| $X_{1m}$ | $X_{2m}$ | $X_{3m}$ | $X_{4m}$ | $X_{5m}$ | $X_{6m}$ | $X_{7m}$ | $X_{8m}$ | $X_{9m}$ | $X_{10m}$ |
|---|---|---|---|---|---|---|---|---|---| where $X_{im}$ is the expression level of the $i^{th}$ gene in organism m. If there are m organisms in the training set, selection of i genes will define m vectors. Note that the methods of the present invention do not require that each the expression value of every single gene used in the vectors be represented in every single vector m. In other words, data from a subject in which one of the genes is not found can still be used for clustering. In such instances, the missing expression value is assigned either a "zero" or some other normalized value. In some embodiments, prior to clustering, the gene expression values are normalized to have a mean value of zero and unit variance.

Those members of the training population that exhibit similar expression patterns across the training group will tend to cluster together. A particular combination of genes of the present invention is considered to be a good classifier in this aspect of the invention when the vectors cluster into the trait groups found in the training population. For instance, if the training population includes patients with good or poor prognosis, a clustering classifier will cluster the population into two groups, with each group uniquely representing either a deregulated growth factor signalling pathway status or a regulated growth factor signalling pathway status.

Clustering is described on pages 211-256 of Duda and Hart, *Pattern Classification and Scene Analysis*, 1973, John Wiley & Sons, Inc., New York. As described in Section 6.7 of Duda, the clustering problem is described as one of finding natural groupings in a dataset. To identify natural groupings, two issues are addressed. First, a way to measure similarity (or dissimilarity) between two samples is determined. This metric (similarity measure) is used to ensure that the samples in one cluster are more like one another than they are to samples in other clusters. Second, a mechanism for partitioning the data into clusters using the similarity measure is determined.

Similarity measures are discussed in Section 6.7 of Duda, where it is stated that one way to begin a clustering investigation is to define a distance function and to compute the matrix of distances between all pairs of samples in a dataset. If distance is a good measure of similarity, then the distance between samples in the same cluster will be significantly less than the distance between samples in different clusters. However, as stated on page 215 of Duda, clustering does not require the use of a distance metric. For example, a nonmetric similarity function s(x, x') can be used to compare two vectors x and x'. Conventionally, s(x, x') is a symmetric function whose value is large when x and x' are somehow "similar". An example of a nonmetric similarity function s(x, x') is provided on page 216 of Duda.

Once a method for measuring "similarity" or "dissimilarity" between points in a dataset has been selected, clustering requires a criterion function that measures the clustering quality of any partition of the data. Partitions of the data set that extremize the criterion function are used to cluster the data. See page 217 of Duda. Criterion functions are discussed in Section 6.8 of Duda.

More recently, Duda et al., Pattern Classification, $2^{nd}$ edition, John Wiley & Sons, Inc. New York, has been published. Pages 537-563 describe clustering in detail. More information on clustering techniques can be found in Kaufman and Rousseeuw, 1990, *Finding Groups in Data: An Introduction to Cluster Analysis*, Wiley, New York, N.Y.; Everitt, 1993, *Cluster analysis* (3d ed.), Wiley, New York, N.Y.; and Backer, 1995, *Computer-Assisted Reasoning in Cluster Analysis*, Prentice Hall, Upper Saddle River, N.J. Particular exemplary clustering techniques that can be used in the present invention include, but are not limited to, hierarchical clustering (agglomerative clustering using nearest-neighbor algorithm, farthest-neighbor algorithm, the average linkage algorithm, the centroid algorithm, or the sum-of-squares algorithm), k-means clustering, fuzzy k-means clustering algorithm, and Jarvis-Patrick clustering.

H. Principal Component Analysis

Principal component analysis (PCA) has been proposed to analyze gene expression data. Principal component analysis is a classical technique to reduce the dimensionality of a data set by transforming the data to a new set of variable (principal components) that summarize the features of the data. See, for example, Jolliffe, 1986, *Principal Component* Analysis, Springer, N.Y. Principal components (PCs) are uncorrelate and are ordered such that the $k^{th}$ PC has the kth largest variance among PCs. The $k^{th}$ PC can be interpreted as the direction that maximizes the variation of the projections of the data points such that it is orthogonal to the first k−1 PCs. The first few PCs capture most of the variation in the data set. In contrast, the last few PCs are often assumed to capture only the residual 'noise' in the data.

PCA can also be used to create a classifier in accordance with the present invention. In such an approach, vectors for a selected set of molecular biomarkers of the invention can be constructed in the same manner described for clustering above. In fact, the set of vectors, where each vector represents the expression values for the select genes from a particular member of the training population, can be considered a matrix. In some embodiments, this matrix is represented in a Free-Wilson method of qualitative binary description of monomers (Kubinyi, 1990, 3D QSAR in drug design theory methods and applications, Pergamon Press, Oxford, pp 589-638), and distributed in a maximally compressed space using PCA so that the first principal component (PC) captures the largest amount of variance information possible, the second principal component (PC) captures the second largest amount of all variance information, and so forth until all variance information in the matrix has been accounted for.

Then, each of the vectors (where each vector represents a member of the training population) is plotted. Many different types of plots are possible. In some embodiments, a one-dimensional plot is made. In this one-dimensional plot, the value for the first principal component from each of the members of the training population is plotted. In this form of plot, the expectation is that members of a first group will cluster in one range of first principal component values and members of a second group will cluster in a second range of first principal component values.

In one example, the training population comprises two classification groups. The first principal component is computed using the molecular biomarker expression values for the select genes of the present invention across the entire training population data set where the classification outcomes are known. Then, each member of the training set is plotted as a function of the value for the first principal component. In this example, those members of the training population in which the first principal component is positive represent one classification outcome and those members of the training population in which the first principal component is negative represent the other classification outcome.

In some embodiments, the members of the training population are plotted against more than one principal component. For example, in some embodiments, the members of the training population are plotted on a two-dimensional plot in which the first dimension is the first principal component and the second dimension is the second principal component. In such a two-dimensional plot, the expectation is that members of each subgroup represented in the training population will cluster into discrete groups. For example, a first cluster of members in the two-dimensional plot will represent subjects in the first classification group, a second cluster of members in the two-dimensional plot will represent subjects in the second classification group, and so forth.

In some embodiments, the members of the training population are plotted against more than two principal components and a determination is made as to whether the members of the training population are clustering into groups that each uniquely represents a subgroup found in the training population. In some embodiments, principal component analysis is performed by using the R mva package (Anderson, 1973, *Cluster Analysis for applications*, Academic Press, New York 1973; Gordon, *Classification*, Second Edition, Chapman and Hall, CRC, 1999.). Principal component analysis is further described in Duda, *Pattern Classification*, Second Edition, 2001, John Wiley & Sons, Inc.

I. Nearest Neighbor Classifier Analysis

Nearest neighbor classifiers are memory-based and require no model to be fit. Given a query point $x_0$, the k training points $x_{(r)}$, r, ..., k closest in distance to $x_0$ are identified and then the point $x_0$ is classified using the k nearest neighbors. Ties can be broken at random. In some embodiments, Euclidean distance in feature space is used to determine distance as:

$$d_{(i)} = \|x_{(i)} - x_0\|.$$

Typically, when the nearest neighbor algorithm is used, the expression data used to compute the linear discriminant is standardized to have mean zero and variance 1. In the present invention, the members of the training population are randomly divided into a training set and a test set. For example, in one embodiment, two thirds of the members of the training population are placed in the training set and one third of the members of the training population are placed in the test set. Profiles of a selected set of molecular biomarkers of the invention represents the feature space into which members of the test set are plotted. Next, the ability of the training set to correctly characterize the members of the test set is computed. In some embodiments, nearest neighbor computation is performed several times for a given combination of genes of the present invention. In each iteration of the computation, the members of the training population are randomly assigned to the training set and the test set. Then, the quality of the combination of genes is taken as the average of each such iteration of the nearest neighbor computation.

The nearest neighbor rule can be refined to deal with issues of unequal class priors, differential misclassification costs, and feature selection. Many of these refinements involve some form of weighted voting for the neighbors. For more information on nearest neighbor analysis, see Duda, *Pattern Classification*, Second Edition, 2001, John Wiley & Sons, Inc; and Hastie, 2001, *The Elements of Statistical Learning*, Springer, N.Y.

J. Evolutionary Methods

Inspired by the process of biological evolution, evolutionary methods of classifier design employ a stochastic search for an optimal classifier. In broad overview, such methods create several classifiers—a population—from measurements of gene products of the present invention. Each classifier varies somewhat from the other. Next, the classifiers are scored on expression data across the training population. In keeping with the analogy with biological evolution, the resulting (scalar) score is sometimes called the fitness. The classifiers are ranked according to their score and the best classifiers are retained (some portion of the total population of classifiers). Again, in keeping with biological terminology, this is called survival of the fittest. The classifiers are stochastically altered in the next generation—the children or offspring. Some offspring classifiers will have higher scores than their parent in the previous generation, some will have lower scores. The overall process is then repeated for the subsequent generation: The classifiers are scored and the best ones are retained, randomly altered to give yet another generation, and so on. In part, because of the ranking, each generation has, on average, a slightly higher score than the previous one. The process is halted when the single best classifier in a generation has a score that exceeds a desired criterion value. More information on evolutionary methods is found in, for example, Duda, *Pattern Classification*, Second Edition, 2001, John Wiley & Sons, Inc.

K. Bagging, Boosting and the Random Subspace Method

Bagging, boosting and the random subspace method are combining techniques that can be used to improve weak classifiers. These techniques are designed for, and usually applied to, decision trees. In addition, Skurichina and Duin provide evidence to suggest that such techniques can also be useful in linear discriminant analysis.

In bagging, one samples the training set, generating random independent bootstrap replicates, constructs the classifier on each of these, and aggregates them by a simple majority Vote in the final decision rule. See, for example, Breiman, 1996, Machine Learning 24, 123-140; and Efron & Tibshirani, *An Introduction to Bootstrap*, Chapman & Hall, New York, 1993.

In boosting, classifiers are constructed on weighted versions of the training set, which are dependent on previous classification results. Initially, all objects have equal weights, and the first classifier is constructed on this data set. Then, weights are changed according to the performance of the classifier. Erroneously classified objects (molecular biomarkers in the data set) get larger weights, and the next classifier is boosted on the reweighted training set. In this way, a sequence of training sets and classifiers is obtained, which is then combined by simple majority voting or by weighted majority voting in the final decision. See, for example, Freund & Schapire, "Experiments with a new boosting algorithm," Proceedings 13$^{th}$ International Conference on Machine Learning, 1996, 148-156.

To illustrate boosting, consider the case where there are two phenotypic groups exhibited by the population under study, phenotype 1, and phenotype 2. Given a vector of molecular markers X, a classifier G(X) produces a prediction taking one of the type values in the two value set: {phenotype 1, phenotype 2}. The error rate on the training sample is $$\overline{err} = \frac{1}{N} \sum_{i=1}^{N} I(y_i \neq G(x_i))$$

where N is the number of subjects in the training set (the sum total of the subjects that have either phenotype 1 or phenotype 2).

A weak classifier is one whose error rate is only slightly better than random guessing. In the boosting algorithm, the weak classification algorithm is repeatedly applied to modified versions of the data, thereby producing a sequence of weak classifiers $G_m(x)$, m,=1, 2, . . . , M. The predictions from all of the classifiers in this sequence are then combined through a weighted majority vote to produce the final prediction:

$$G(x) = \text{sign}\left(\sum_{m=1}^{M} \alpha_m G_m(x)\right)$$

Here $\alpha_1, \alpha_2, \ldots, \alpha_M$ are computed by the boosting algorithm and their purpose is to weigh the contribution of each respective $G_m(x)$. Their effect is to give higher influence to the more accurate classifiers in the sequence.

The data modifications at each boosting step consist of applying weights $w_1, w_2, \ldots, w_n$ to each of the training observations $(x_i, y_i)$, i=1, 2, . . . , N. Initially all the weights are set to $w_i$=1/N, so that the first step simply trains the classifier on the data in the usual manner. For each successive iteration m=2, 3, . . . , M the observation weights are individually modified and the classification algorithm is reapplied to the weighted observations. At stem m, those observations that were misclassified by the classifier $G_{m-1}(x)$ induced at the previous step have their weights increased, whereas the weights are decreased for those that were classified correctly. Thus as iterations proceed, observations that are difficult to correctly classify receive ever-increasing influence. Each successive classifier is thereby forced to concentrate on those training observations that are missed by previous ones in the sequence.

The exemplary boosting algorithm is summarized as follows:
1. Initialize the observation weights $w_i$=1/N, i=1, 2, . . . , N.
2. For m=1 to M:
   (a) Fit a classifier $G_m(x)$ to the training set using weights $w_i$.
   (b) Compute $$err_m = \frac{\sum_{i=1}^{N} w_i I(y_i \neq G_m(x_i))}{\sum_{i=1}^{N} w_i}$$

(c) Compute $\alpha_m = \log((1-err_m)/err_m)$.
   (d) Set $w_i \leftarrow w_i \cdot \exp[\alpha_m \cdot I(y_i \neq G_m(x_i))]$, i=1, 2, . . . , N.

3. Output $G(x) = \text{sign}\left[\sum_{m=1}^{M} \alpha_m G_m(x)\right]$

In the algorithm, the current classifier $G_m(x)$ is induced on the weighted observations at line 2a. The resulting weighted error rate is computed at line 2b. Line 2c calculates the weight $\alpha_m$ given to $G_m(x)$ in producing the final classifier G(x) (line 3). The individual weights of each of the observations are updated for the next iteration at line 2d. Observations misclassified by $G_m(x)$ have their weights scaled by a factor $\exp(\alpha_m)$, increasing their relative influence for inducing the next classifier $G_{m+1}(x)$ in the sequence. In some embodiments, modifications of the Freund and Schapire, 1997, Journal of Computer and System Sciences 55, pp. 119-139, boosting method are used. See, for example, Hasti et al., *The Elements of Statistical Learning*, 2001, Springer, N.Y., Chapter 10. In some embodiments, boosting or adaptive boosting methods are used.

In some embodiments, modifications of Freund and Schapire, 1997, Journal of Computer and System Sciences 55, pp. 119-139, are used. For example, in some embodiments, feature preselection is performed using a technique such as the nonparametric scoring methods of Park et al., 2002, Pac. Symp. Biocomput. 6, 52-63. Feature preselection is a form of dimensionality reduction in which the genes that discriminate between classifications the best are selected for use in the classifier. Then, the LogitBoost procedure introduced by Friedman et al., 2000, Ann Stat 28, 337-407 is used rather than the boosting procedure of Freund and Schapire. In some embodiments, the boosting and other classification methods of Ben-Dor et al., 2000, Journal of Computational Biology 7, 559-583 are used in the present invention. In some embodiments, the boosting and other classification methods of Freund and Schapire, 1997, Journal of Computer and System Sciences 55, 119-139, are used.

In the random subspace method, classifiers are constructed in random subspaces of the data feature space. These classifiers are usually combined by simple majority voting in the final decision rule. See, for example, Ho, "The Random subspace method for constructing decision forests," IEEE Trans Pattern Analysis and Machine Intelligence, 1998; 20(8): 832-844.

L. Other Algorithms

The pattern classification and statistical techniques described above are merely examples of the types of models that can be used to construct a model for classification. Moreover, combinations of the techniques described above can be used. Some combinations, such as the use of the combination of decision trees and boosting, have been described. However, many other combinations are possible. In addition, in other techniques in the art such as Projection Pursuit and Weighted Voting can be used to construct a classifier.

3.5 Determination of Biomarker Gene Expression Levels 3.5.1 Methods

The expression levels of the biomarker genes in a sample may be determined by any means known in the art. The expression level may be determined by isolating and determining the level (i.e., amount) of nucleic acid transcribed from each biomarker gene. Alternatively, or additionally, the level of specific proteins translated from mRNA transcribed from a biomarker gene may be determined.

The level of expression of specific biomarker genes can be accomplished by determining the amount of mRNA, or polynucleotides derived therefrom, present in a sample. Any method for determining RNA levels can be used. For example, RNA is isolated from a sample and separated on an agarose gel. The separated RNA is then transferred to a solid support, such as a filter. Nucleic acid probes representing one or more biomarkers are then hybridized to the filter by northern hybridization, and the amount of biomarker-derived RNA is determined. Such determination can be visual, or machine-aided, for example, by use of a densitometer. Another method of determining RNA levels is by use of a dot-blot or a slot-blot. In this method, RNA, or nucleic acid derived therefrom, from a sample is labeled. The RNA or nucleic acid derived therefrom is then hybridized to a filter containing oligonucleotides derived from one or more biomarker genes, wherein the oligonucleotides are placed upon the filter at discrete, easily-identifiable locations. Hybridization, or lack thereof, of the labeled RNA to the filter-bound oligonucleotides is determined visually or by densitometer. Polynucleotides can be labeled using a radiolabel or a fluorescent (i.e., visible) label.

These examples are not intended to be limiting. Other methods of determining RNA abundance are known in the art, including, but not limited to quantitative PCR methods, such as TAQMAN®, and Nanostring's NCOUNTER™ Digital Gene Expression System (Seattle, Wash.) (See also WO2007076128; WO2007076129).

The level of expression of particular biomarker genes may also be assessed by determining the level of the specific protein expressed from the biomarker genes. This can be accomplished, for example, by separation of proteins from a sample on a polyacrylamide gel, followed by identification of specific biomarker-derived proteins using antibodies in a western blot. Alternatively, proteins can be separated by two-dimensional gel electrophoresis systems. Two-dimensional gel electrophoresis is well-known in the art and typically involves isoelectric focusing along a first dimension followed by SDS-PAGE electrophoresis along a second dimension. See, e.g., Hames et al, 1990, GEL ELECTROPHORESIS OF PROTEINS: A PRACTICAL APPROACH, IRL Press, New York; Shevchenko et al., Proc. Nat'l Acad. Sci. USA 93:1440-1445 (1996); Sagliocco et al., Yeast 12:1519-1533 (1996); Lander, Science 274:536-539 (1996). The resulting electropherograms can be analyzed by numerous techniques, including mass spectrometric techniques, western blotting and immunoblot analysis using polyclonal and monoclonal antibodies.

Alternatively, biomarker-derived protein levels can be determined by constructing an antibody microarray in which binding sites comprise immobilized, preferably monoclonal, antibodies specific to a plurality of protein species encoded by the cell genome. Preferably, antibodies are present for a substantial fraction of the biomarker-derived proteins of interest. Methods for making monoclonal antibodies are well known (see, e.g., Harlow and Lane, 1988, ANTIBODIES: A LABORATORY MANUAL, Cold Spring Harbor, N.Y., which is incorporated in its entirety for all purposes). In one embodiment, monoclonal antibodies are raised against synthetic peptide fragments designed based on genomic sequence of the cell. With such an antibody array, proteins from the cell are contacted to the array, and their binding is assayed with assays known in the art. Generally, the expression, and the level of expression, of proteins of diagnostic or prognostic interest can be detected through immunohistochemical staining of tissue slices or sections.

Finally, expression of biomarker genes in a number of tissue specimens may be characterized using a "tissue array" (Kononen et al., Nat. Med 4(7):844-7 (1998)). In a tissue array, multiple tissue samples are assessed on the same microarray. The arrays allow in situ detection of RNA and protein levels; consecutive sections allow the analysis of multiple samples simultaneously.

3.5.2 Microarrays

In preferred embodiments, polynucleotide microarrays are used to measure expression so that the expression status of each of the biomarkers above is assessed simultaneously. In a specific embodiment, the invention provides for oligonucleotide or cDNA arrays comprising probes hybridizable to the genes corresponding to each of the biomarker sets described above (i.e., biomarkers to determine the molecular type or subtype of a tumor; biomarkers to classify the growth factor pathway signaling status of a tumor; biomarkers to predict response of a subject to a compound that modulates the growth factor signaling pathway; biomarkers to measure pharmacodynamic effect of a therapeutic agent on the growth factor signaling pathway).

The microarrays provided by the present invention may comprise probes hybridizable to the genes corresponding to biomarkers able to distinguish the status of one, two, or all three of the clinical conditions noted above. In particular, the invention provides polynucleotide arrays comprising probes to a subset or subsets of at least 5, 10, 20, 30, 40, 50, 100 genetic biomarkers, up to the full set of 101 biomarkers of Tables 5a and 5b, which distinguish growth factor signaling pathway deregulated and regulated patients or tumors. In another particular embodiment, the invention provides polynucleotide arrays comprising probes to a subset or subsets of at least 5, 10, 20, 30, 40, 50, 60, 70 genetic biomarkers, up to the full set of 86 biomarkers of Table 11, which distinguish growth factor signaling pathway deregulated and regulated patients or tumors. In yet another embodiment, the invention provides arrays comprising probes to a subset or subsets of at least 5, 10, 20, 30 genetic biomarkers, up to the full set of 39 biomarkers of Table 13, which distinguish patients or samples with high glycolysis pathway activity.

In yet another specific embodiment, microarrays that are used in the methods disclosed herein optionally comprise biomarkers additional to at least some of the biomarkers listed in Table 5. For example, in a specific embodiment, the microarray is a screening or scanning array as described in Altschuler et al., International Publication WO 02/18646, published Mar. 7, 2002 and Scherer et al., International Publication WO 02/16650, published Feb. 28, 2002. The scanning and screening arrays comprise regularly-spaced, positionally-addressable probes derived from genomic nucleic acid sequence, both expressed and unexpressed. Such arrays may comprise probes corresponding to a subset of, or all of, the biomarkers listed in Tables 5, or a subset thereof as described above, and can be used to monitor biomarker expression in the same way as a microarray containing only biomarkers listed in Table 5.

In yet another specific embodiment, the microarray is a commercially-available cDNA microarray that comprises at least five of the biomarkers listed in Table 5. Preferably, a commercially-available cDNA microarray comprises all of the biomarkers listed in Table 5. However, such a microarray may comprise 5, 10, 15, 25, 50, 100 or more of the biomarkers in any of Table 5, up to the maximum number of biomarkers in a Table 5, and may comprise all of the biomarkers in any one of Table 5 and a subset of another of Table 5, or subsets of each as described above. In a specific embodiment of the microarrays used in the methods disclosed herein, the biomarkers that are all or a portion of Table 5 make up at least 50%, 60%, 70%, 80%, 90%, 95% or 98% of the probes on the microarray.

General methods pertaining to the construction of microarrays comprising the biomarker sets and/or subsets above are described in the following sections.

3.5.2.1 Construction of Microarrays

Microarrays are prepared by selecting probes which comprise a polynucleotide sequence, and then immobilizing such probes to a solid support or surface. For example, the probes may comprise DNA sequences, RNA sequences, or copolymer sequences of DNA and RNA. The polynucleotide sequences of the probes may also comprise DNA and/or RNA analogues, or combinations thereof. For example, the poly- nucleotide sequences of the probes may be full or partial fragments of genomic DNA. The polynucleotide sequences of the probes may also be synthesized nucleotide sequences, such as synthetic oligonucleotide sequences. The probe sequences can be synthesized either enzymatically in vivo, enzymatically in vitro (e.g., by PCR), or non-enzymatically in vitro.

The probe or probes used in the methods of the invention are preferably immobilized to a solid support which may be either porous or non-porous. For example, the probes of the invention may be polynucleotide sequences which are attached to a nitrocellulose or nylon membrane or filter covalently at either the 3' or the 5' end of the polynucleotide. Such hybridization probes are well known in the art (see, e.g., Sambrook et al., MOLECULAR CLONING—A LABORATORY MANUAL (2ND ED.), Vols. 1-3, Cold Spring Harbor Laboratory, Cold Spring Harbor, N.Y. (1989). Alternatively, the solid support or surface may be a glass or plastic surface. In a particularly preferred embodiment, hybridization levels are measured to microarrays of probes consisting of a solid phase on the surface of which are immobilized a population of polynucleotides, such as a population of DNA or DNA mimics, or, alternatively, a population of RNA or RNA mimics. The solid phase may be a nonporous or, optionally, a porous material such as a gel.

In preferred embodiments, a microarray comprises a support or surface with an ordered array of binding (e.g., hybridization) sites or "probes" each representing one of the biomarkers described herein. Preferably the microarrays are addressable arrays, and more preferably positionally addressable arrays. More specifically, each probe of the array is preferably located at a known, predetermined position on the solid support such that the identity (i.e., the sequence) of each probe can be determined from its position in the array (i.e., on the support or surface). In preferred embodiments, each probe is covalently attached to the solid support at a single site.

Microarrays can be made in a number of ways, of which several are described below. However produced, microarrays share certain characteristics. The arrays are reproducible, allowing multiple copies of a given array to be produced and easily compared with each other. Preferably, microarrays are made from materials that are stable under binding (e.g., nucleic acid hybridization) conditions. The microarrays are preferably small, e.g., between 1 $cm^2$ and 25 $cm^2$, between 12 $cm^2$ and 13 $cm^2$, or 3 $cm^2$. However, larger arrays are also contemplated and may be preferable, e.g., for use in screening arrays. Preferably, a given binding site or unique set of binding sites in the microarray will specifically bind (e.g., hybridize) to the product of a single gene in a cell (e.g., to a specific mRNA, or to a specific cDNA derived therefrom). However, in general, other related or similar sequences will cross hybridize to a given binding site.

The microarrays of the present invention include one or more test probes, each of which has a polynucleotide sequence that is complementary to a subsequence of RNA or DNA to be detected. Preferably, the position of each probe on the solid surface is known. Indeed, the microarrays are preferably positionally addressable arrays. Specifically, each probe of the array is preferably located at a known, predetermined position on the solid support such that the identity (i.e., the sequence) of each probe can be determined from its position on the array (i.e., on the support or surface).

According to the invention, the microarray is an array (i.e., a matrix) in which each position represents one of the biomarkers described herein. For example, each position can contain a DNA or DNA analogue based on genomic DNA to which a particular RNA or cDNA transcribed from that genetic biomarker can specifically hybridize. The DNA or DNA analogue can be, e.g., a synthetic oligomer or a gene fragment. In one embodiment, probes representing each of the biomarkers is present on the array.

3.5.2.2 Preparing Probes for Microarrays

As noted above, the "probe" to which a particular polynucleotide molecule specifically hybridizes according to the invention contains a complementary genomic polynucleotide sequence. The probes of the microarray preferably consist of nucleotide sequences of no more than 1,000 nucleotides. In some embodiments, the probes of the array consist of nucleotide sequences of 10 to 1,000 nucleotides. In a preferred embodiment, the nucleotide sequences of the probes are in the range of 10-200 nucleotides in length and are genomic sequences of a species of organism, such that a plurality of different probes is present, with sequences complementary and thus capable of hybridizing to the genome of such a species of organism, sequentially tiled across all or a portion of such genome. In other specific embodiments, the probes are in the range of 10-30 nucleotides in length, in the range of 10-40 nucleotides in length, in the range of 20-50 nucleotides in length, in the range of 40-80 nucleotides in length, in the range of 50-150 nucleotides in length, in the range of 80-120 nucleotides in length, and most preferably are 60 nucleotides in length.

The probes may comprise DNA or DNA "mimics" (e.g., derivatives and analogues) corresponding to a portion of an organism's genome. In another embodiment, the probes of the microarray are complementary RNA or RNA mimics. DNA mimics are polymers composed of subunits capable of specific, Watson-Crick-like hybridization with DNA, or of specific hybridization with RNA. The nucleic acids can be modified at the base moiety, at the sugar moiety, or at the phosphate backbone. Exemplary DNA mimics include, e.g., phosphorothioates.

DNA can be obtained, e.g., by polymerase chain reaction (PCR) amplification of genomic DNA or cloned sequences. PCR primers are preferably chosen based on a known sequence of the genome that will result in amplification of specific fragments of genomic DNA. Computer programs that are well known in the art are useful in the design of primers with the required specificity and optimal amplification properties, such as Oligo version 5.0 (National Biosciences). Typically each probe on the microarray will be between 10 bases and 50,000 bases, usually between 300 bases and 1,000 bases in length. PCR methods are well known in the art, and are described, for example, in Innis et al., eds., PCR PROTOCOLS: A GUIDE TO METHODS AND APPLICATIONS, Academic Press Inc., San Diego, Calif. (1990). It will be apparent to one skilled in the art that controlled robotic systems are useful for isolating and amplifying nucleic acids.

An alternative, preferred means for generating the polynucleotide probes of the microarray is by synthesis of synthetic polynucleotides or oligonucleotides, e.g., using N-phosphonate or phosphoramidite chemistries (Froehler et al., Nucleic Acid Res. 14:5399-5407 (1986); McBride et al., Tetrahedron Lett. 24:246-248 (1983)). Synthetic sequences are typically between about 10 and about 500 bases in length, more typically between about 20 and about 100 bases, and most preferably between about 40 and about 70 bases in length. In some embodiments, synthetic nucleic acids include non-natural bases, such as, but by no means limited to, inosine. As noted above, nucleic acid analogues may be used as binding sites for hybridization. An example of a suitable nucleic acid analogue is peptide nucleic acid (see, e.g., Egholm et al., Nature 363:566-568 (1993); U.S. Pat. No. 5,539,083). Probes are preferably selected using an algorithm that takes into account binding energies, base composition, sequence complexity, cross-hybridization binding energies, and secondary structure (see Friend et al., International Patent Publication WO 01/05935, published Jan. 25, 2001; Hughes et al., Nat. Biotech. 19:342-7 (2001)).

A skilled artisan will also appreciate that positive control probes, e.g., probes known to be complementary and hybridizable to sequences in the target polynucleotide molecules, and negative control probes, e.g., probes known to not be complementary and hybridizable to sequences in the target polynucleotide molecules, should be included on the array. In one embodiment, positive controls are synthesized along the perimeter of the array. In another embodiment, positive controls are synthesized in diagonal stripes across the array. In still another embodiment, the reverse complement for each probe is synthesized next to the position of the probe to serve as a negative control. In yet another embodiment, sequences from other species of organism are used as negative controls or as "spike-in" controls.

3.5.2.3 Attaching Probes to the Solid Surface

The probes are attached to a solid support or surface, which may be made, e.g., from glass, plastic (e.g., polypropylene, nylon), polyacrylamide, nitrocellulose, gel, or other porous or nonporous material. A preferred method for attaching the nucleic acids to a surface is by printing on glass plates, as is described generally by Schena et al, Science 270:467-470 (1995). This method is especially useful for preparing microarrays of cDNA (See also, DeRisi et al, Nature Genetics 14:457-460 (1996); Shalon et al., Genome Res. 6:639-645 (1996); and Schena et al., Proc. Natl. Acad. Sci. U.S.A. 93:10539-11286 (1995)).

A second preferred method for making microarrays is by making high-density oligonucleotide arrays. Techniques are known for producing arrays containing thousands of oligonucleotides complementary to defined sequences, at defined locations on a surface using photolithographic techniques for synthesis in situ (see, Fodor et al., 1991, Science 251:767-773; Pease et al, 1994, Proc. Natl. Acad. Sci. U.S.A. 91:5022-5026; Lockhart et al., 1996, Nature Biotechnology 14:1675; U.S. Pat. Nos. 5,578,832; 5,556,752; and 5,510,270) or other methods for rapid synthesis and deposition of defined oligonucleotides (Blanchard et al., Biosensors & Bioelectronics 11:687-690). When these methods are used, oligonucleotides (e.g., 60-mers) of known sequence are synthesized directly on a surface such as a derivatized glass slide. Usually, the array produced is redundant, with several oligonucleotide molecules per RNA.

Other methods for making microarrays, e.g., by masking (Maskos and Southern, 1992, Nuc. Acids. Res. 20:1679-1684), may also be used. In principle, and as noted supra, any type of array, for example, dot blots on a nylon hybridization membrane (see Sambrook et al., MOLECULAR CLONING—A LABORATORY MANUAL (2ND ED.), Vols. 1-3, Cold Spring Harbor Laboratory, Cold Spring Harbor, N.Y. (1989)) could be used. However, as will be recognized by those skilled in the art, very small arrays will frequently be preferred because hybridization volumes will be smaller.

In one embodiment, the arrays of the present invention are prepared by synthesizing polynucleotide probes on a support. In such an embodiment, polynucleotide probes are attached to the support covalently at either the 3' or the 5' end of the polynucleotide.

In a particularly preferred embodiment, microarrays of the invention are manufactured by means of an ink jet printing device for oligonucleotide synthesis, e.g., using the methods and systems described by Blanchard in U.S. Pat. No. 6,028,189; Blanchard et al., 1996, Biosensors and Bioelectronics 11:687-690; Blanchard, 1998, in SYNTHETIC DNA ARRAYS IN GENETIC ENGINEERING, Vol. 20, J. K. Setlow, Ed., Plenum Press, New York at pages 111-123. Specifically, the oligonucleotide probes in such microarrays are preferably synthesized in arrays, e.g., on a glass slide, by serially depositing individual nucleotide bases in "microdroplets" of a high surface tension solvent such as propylene carbonate. The microdroplets have small volumes (e.g., 100 pL or less, more preferably 50 pL or less) and are separated from each other on the microarray (e.g., by hydrophobic domains) to form circular surface tension wells which define the locations of the array elements (i.e., the different probes). Microarrays manufactured by this ink-jet method are typically of high density, preferably having a density of at least about 2,500 different probes per 1 $cm^2$. The polynucleotide probes are attached to the support covalently at either the 3' or the 5' end of the polynucleotide.

3.5.2.4 Target Polynucleotide Molecules

The polynucleotide molecules which may be analyzed by the present invention (the "target polynucleotide molecules") may be from any clinically relevant source, but are expressed RNA or a nucleic acid derived therefrom (e.g., cDNA or amplified RNA derived from cDNA that incorporates an RNA polymerase promoter), including naturally occurring nucleic acid molecules, as well as synthetic nucleic acid molecules. In one embodiment, the target polynucleotide molecules comprise RNA, including, but by no means limited to, total cellular RNA, poly(A)+ messenger RNA (mRNA) or fraction thereof, cytoplasmic mRNA, or RNA transcribed from cDNA (i.e., cRNA; see, e.g., Linsley & Schelter, U.S. patent application Ser. No. 09/411,074, filed Oct. 4, 1999, or U.S. Pat. Nos. 5,545,522, 5,891,636, or 5,716,785). Methods for preparing total and poly(A)+ RNA are well known in the art, and are described generally, e.g., in Sambrook et al., MOLECULAR CLONING—A LABORATORY MANUAL (2ND ED.), Vols. 1-3, Cold Spring Harbor Laboratory, Cold Spring Harbor, N.Y. (1989). In one embodiment, RNA is extracted from cells of the various types of interest in this invention using guanidinium thiocyanate lysis followed by CsCl centrifugation (Chirgwin et al., 1979, Biochemistry 18:5294-5299). In another embodiment, total RNA is extracted using a silica gel-based column, commercially available examples of which include RNeasy (Qiagen, Valencia, Calif.) and StrataPrep (Stratagene, La Jolla, Calif.). In an alternative embodiment, which is preferred for S. cerevisiae, RNA is extracted from cells using phenol and chloroform, as described in Ausubel et al., eds., 1989, CURRENT PROTOCOLS IN MOLECULAR BIOLOGY, Vol. M, Green Publishing Associates, Inc., John Wiley & Sons, Inc., New York, at pp. 13.12.1-13.12.5). Poly(A)+ RNA can be selected, e.g., by selection with oligo-dT cellulose or, alternatively, by oligo-dT primed reverse transcription of total cellular RNA. In one embodiment, RNA can be fragmented by methods known in the art, e.g., by incubation with $ZnCl_2$, to generate fragments of RNA. In another embodiment, the polynucleotide molecules analyzed by the invention comprise cDNA, or PCR products of amplified RNA or cDNA.

In one embodiment, total RNA, mRNA, or nucleic acids derived therefrom, is isolated from a sample taken from a person afflicted with breast cancer. Target polynucleotide molecules that are poorly expressed in particular cells may be enriched using normalization techniques (Bonaldo et al., 1996, Genome Res. 6:791-806).

As described above, the target polynucleotides are detectably labeled at one or more nucleotides. Any method known in the art may be used to detectably label the target polynucleotides. Preferably, this labeling incorporates the label uniformly along the length of the RNA, and more preferably, the labeling is carried out at a high degree of efficiency. One embodiment for this labeling uses oligo-dT primed reverse transcription to incorporate the label; however, conventional methods of this method are biased toward generating 3' end fragments. Thus, in a preferred embodiment, random primers (e.g., 9-mers) are used in reverse transcription to uniformly incorporate labeled nucleotides over the fill length of the target polynucleotides. Alternatively, random primers may be used in conjunction with PCR methods or T7 promoter-based in vitro transcription methods in order to amplify the target polynucleotides.

In a preferred embodiment, the detectable label is a luminescent label. For example, fluorescent labels, bio-luminescent labels, chemi-luminescent labels, and colorimetric labels may be used in the present invention. In a highly preferred embodiment, the label is a fluorescent label, such as a fluorescein, a phosphor, a rhodamine, or a polymethine dye derivative. Examples of commercially available fluorescent labels include, for example, fluorescent phosphoramidites such as FluorePrime (Amersham Pharmacia, Piscataway, N.J.), Fluoredite (Millipore, Bedford, Mass.), FAM (ABI, Foster City, Calif.), and Cy3 or Cy5 (Amersham Pharmacia, Piscataway, N.J.). In another embodiment, the detectable label is a radiolabeled nucleotide.

In a further preferred embodiment, target polynucleotide molecules from a patient sample are labeled differentially from target polynucleotide molecules of a standard. The standard can comprise target polynucleotide molecules from normal individuals (i.e., those not afflicted with cancer). In a highly preferred embodiment, the standard comprises target polynucleotide molecules pooled from samples from normal individuals or tumor samples from individuals having cancer. In another embodiment, the target polynucleotide molecules are derived from the same individual, but are taken at different time points, and thus indicate the efficacy of a treatment by a change in expression of the biomarkers, or lack thereof during and after the course of treatment (i.e., growth factor pathway therapeutic agent), wherein a change in the expression of the biomarkers from a growth factor pathway deregulation pattern to a growth factor pathway regulation pattern indicates that the treatment is efficacious. In this embodiment, different timepoints are differentially labeled.

3.5.2.5 Hybridization to Microarrays

Nucleic acid hybridization and wash conditions are chosen so that the target polynucleotide molecules specifically bind or specifically hybridize to the complementary polynucleotide sequences of the array, preferably to a specific array site, wherein its complementary DNA is located.

Arrays containing double-stranded probe DNA situated thereon are preferably subjected to denaturing conditions to render the DNA single-stranded prior to contacting with the target polynucleotide molecules. Arrays containing single-stranded probe DNA (e.g., synthetic oligodeoxyribonucleic acids) may need to be denatured prior to contacting with the target polynucleotide molecules, e.g., to remove hairpins or dimers which form due to self complementary sequences.

Optimal hybridization conditions will depend on the length (e.g., oligomer versus polynucleotide greater than 200 bases) and type (e.g., RNA, or DNA) of probe and target nucleic acids. One of skill in the art will appreciate that as the oligonucleotides become shorter, it may become necessary to adjust their length to achieve a relatively uniform melting temperature for satisfactory hybridization results. General parameters for specific (i.e., stringent) hybridization conditions for nucleic acids are described in Sambrook et al., MOLECULAR CLONING—A LABORATORY MANUAL (2ND ED.), Vols. 1-3, Cold Spring Harbor Laboratory, Cold Spring Harbor, N.Y. (1989), and in Ausubel et al., CURRENT PROTOCOLS IN MOLECULAR BIOLOGY, vol. 2, Current Protocols Publishing, New York (1994). Typical hybridization conditions for the cDNA microarrays of Schena et al. are hybridization in 5×SSC plus 0.2% SDS at 65° C. for four hours, followed by washes at 25° C. in low stringency wash buffer (1×SSC plus 0.2% SDS), followed by 10 minutes at 25° C. in higher stringency wash buffer (0.1×SSC plus 0.2% SDS) (Schena et al., Proc. Natl. Acad. Sci. U.S.A. 93:10614 (1993)). Useful hybridization conditions are also provided in, e.g., Tijessen, 1993, HYBRIDIZATION WITH NUCLEIC ACID PROBES, Elsevier Science Publishers B. V.; and Kricka, 1992, NONISOTOPIC DNA PROBE TECHNIQUES, Academic Press, San Diego, Calif.

Particularly preferred hybridization conditions include hybridization at a temperature at or near the mean melting temperature of the probes (e.g., within 5° C., more preferably within 2° C.) in 1 M NaCl, 50 mM MES buffer (pH 6.5), 0.5% sodium sarcosine and 30% formamide.

3.5.2.6 Signal Detection and Data Analysis

When fluorescently labeled probes are used, the fluorescence emissions at each site of a microarray may be, preferably, detected by scanning confocal laser microscopy. In one embodiment, a separate scan, using the appropriate excitation line, is carried out for each of the two fluorophores used. Alternatively, a laser may be used that allows simultaneous specimen illumination at wavelengths specific to the two fluorophores and emissions from the two fluorophores can be analyzed simultaneously (see Shalon et al., 1996, "A DNA microarray system for analyzing complex DNA samples using two-color fluorescent probe hybridization," Genome Research 6:639-645, which is incorporated by reference in its entirety for all purposes). In a preferred embodiment, the arrays are scanned with a laser fluorescent scanner with a computer controlled X-Y stage and a microscope objective. Sequential excitation of the two fluorophores is achieved with a multi-line, mixed gas laser and the emitted light is split by wavelength and detected with two photomultiplier tubes. Fluorescence laser scanning devices are described in Schena et al., Genome Res. 6:639-645 (1996), and in other references cited herein. Alternatively, the fiber-optic bundle described by Ferguson et al., Nature Biotech. 14:1681-1684 (1996), may be used to monitor mRNA abundance levels at a large number of sites simultaneously.

Signals are recorded and, in a preferred embodiment, analyzed by computer, e.g., using a 12 or 16 bit analog to digital board. In one embodiment the scanned image is despeckled using a graphics program (e.g., Hijaak Graphics Suite) and then analyzed using an image gridding program that creates a spreadsheet of the average hybridization at each wavelength at each site. If necessary, an experimentally determined correction for "cross talk" (or overlap) between the channels for the two fluorophores may be made. For any particular hybridization site on the transcript array, a ratio of the emission of the two fluorophores can be calculated. The ratio is independent of the absolute expression level of the cognate gene, but is useful for genes whose expression is significantly modulated in association with the different breast cancer-related condition.

3.6 Computer-Facilitated Analysis

The present invention further provides for kits comprising the biomarker sets above. In a preferred embodiment, the kit contains a microarray ready for hybridization to target polynucleotide molecules, plus software for the data analyses described above.

The analytic methods described in the previous sections can be implemented by use of the following computer systems and according to the following programs and methods. A Computer system comprises internal components linked to external components. The internal components of a typical computer system include a processor element interconnected with a main memory. For example, the computer system can be an Intel 8086-, 80386-, 80486-, Pentium®, or Pentium®-based processor with preferably 32 MB or more of main memory.

The external components may include mass storage. This mass storage can be one or more hard disks (which are typically packaged together with the processor and memory). Such hard disks are preferably of 1 GB or greater storage capacity. Other external components include a user interface device, which can be a monitor, together with an inputting device, which can be a "mouse", or other graphic input devices, and/or a keyboard. A printing device can also be attached to the computer.

Typically, a computer system is also linked to network link, which can be part of an Ethernet link to other local computer systems, remote computer systems, or wide area communication networks, such as the Internet. This network link allows the computer system to share data and processing tasks with other computer systems.

Loaded into memory during operation of this system are several software components, which are both standard in the art and special to the instant invention. These software components collectively cause the computer system to function according to the methods of this invention. These software components are typically stored on the mass storage device. A software component comprises the operating system, which is responsible for managing computer system and its network interconnections. This operating system can be, for example, of the Microsoft Windows® family, such as Windows 3.1, Windows 95, Windows 98, Windows 2000, or Windows NT. The software component represents common languages and functions conveniently present on this system to assist programs implementing the methods specific to this invention. Many high or low level computer languages can be used to program the analytic methods of this invention. Instructions can be interpreted during run-time or compiled. Preferred languages include C/C++, FORTRAN and JAVA. Most preferably, the methods of this invention are programmed in mathematical software packages that allow symbolic entry of equations and high-level specification of processing, including some or all of the algorithms to be used, thereby freeing a user of the need to procedurally program individual equations or algorithms. Such packages include Mathlab from Mathworks (Natick, Mass.), Mathematica® from Wolfram Research (Champaign, Ill.), or S-Plus®D from Math Soft (Cambridge, Mass.). Specifically, the software component includes the analytic methods of the invention as programmed in a procedural language or symbolic package.

The software to be included with the kit comprises the data analysis methods of the invention as disclosed herein. In particular, the software may include mathematical routines for biomarker discovery, including the calculation of correlation coefficients between clinical categories (i.e., growth factor signaling pathway regulation status) and biomarker expression. The software may also include mathematical routines for calculating the correlation between sample biomarker expression and control biomarker expression, using array-generated fluorescence data, to determine the clinical classification of a sample.

In an exemplary implementation, to practice the methods of the present invention, a user first loads experimental data into the computer system. These data can be directly entered by the user from a monitor, keyboard, or from other computer systems linked by a network connection, or on removable storage media such as a CD-ROM, floppy disk (not illustrated), tape drive (not illustrated), ZIP® drive (not illustrated) or through the network. Next the user causes execution of expression profile analysis software which performs the methods of the present invention.

In another exemplary implementation, a user first loads experimental data and/or databases into the computer system. This data is loaded into the memory from the storage media or from a remote computer, preferably from a dynamic geneset database system, through the network. Next the user causes execution of software that performs the steps of the present invention.

Alternative computer systems and software for implementing the analytic methods of this invention will be apparent to one of skill in the art and are intended to be comprehended within the accompanying claims. In particular, the accompanying claims are intended to include the alternative program structures for implementing the methods of this invention that will be readily apparent to one of skill in the art.

EXAMPLES

Example 1

Identification of Genes Regulated by AKT Inhibition in Colon Cancer Cell Lines

In order to identify a gene expression signature of growth factor signaling pathway deregulation in human tumors, six colon carcinoma cell lines HCT-8 (ATCC #CCL-244), LoVo (ATCC #CCL-229), COLO205 (ATCC #CLL-222), DLD-1 (ATCC #CCL-221), HCT-116 (ATCC #CCL-247), and HCT-15 (ATCC #CCL-225) were initially expression profiled by microarray to identify genes that are responsive to AKT1/2 small molecule inhibition. The six colon cancer cell lines were treated with either 4 μM AKT1/2 inhibitor L-001154547 ('547; 3-phenyl-2-(4-{[4-(5-pyridin-2-yl-1H-1,2,4-triazol-3-yl)piperidin-1-yl]methyl}phenyl)-1,6-naphthyridin-5(6H)-one; disclosed in WO2006065601) or 4 μM AKT1/2 inhibitor L-01173931 ('931; 6-Methyl-3-phenyl-2-(4-{[4-(5-pyridin-2-yl-1H-1,2,4-triazol-3-yl)piperidin-1-yl]methyl}phenyl)-1,6-naphthyridin-5(6H)-one; disclosed in WO2006065601) for 6 or 24 hours. Two AKT1/2 inhibitors were used for the profiling experiments as a way to offset any off-target effects of any one compound. These six cell lines were chosen based on previous data on 19 colon cancer cell lines which indicated that three of the colon cancer cell lines (HCT-8, LoVo, COLO205) were relatively sensitive to AKT inhibition by the '547 compound in vitro, while the other three cell lines (DLD-1, HCT-116, and HCT-15) were relatively resistant to AKT inhibition by the '547 compound (see FIG. 2).

For gene expression profiling, total RNA was extracted from the cell samples and amplified using standard protocols (Hughes et al., 2001, Nat. Biotechnol. 19:342-47; Van't Veer et al., 2002, Nature 415:530-36). Expression of about 44,000 human genes was determined by hybridization to 60-mer oligonucleotide arrays (Agilent Technologies, Inc., Santa Clara, Calif.), using Stratagene Universal Human Reference RNA (Stratagene Corporation, La Jolla, Calif.). Gene expression was measured and normalized using standard methods as previously described (Hughes et al., 2001, supra; Van't Veer et al., 2002, supra). Data were normalized to average expression in vehicle only treated cells.

ANOVA analysis of post-treatment changes showed a significant differential expression associated with both treatment and response to AKT compound therapy. 3,500 genes were differentially regulated post-treatment (p-value<0.01), while 1,600 genes were differentially regulated between relatively sensitive (HCT-8, LoVo, COLO205) and relatively resistant cell lines (DLD-1, HCT-116, and HCT-15) (FIG. 3A; p-value<0.01). Discriminant analysis of responders and non-responders using post-dose changes of gene expression was 90% accurate in leave-one-out cross-validation (data not shown). Among these 1,600 genes, we focused on 399 genes that were tightly correlated (r>0.7) with changes in expression of IRS2 across this dataset, a key mediator of growth pathway signaling (FIG. 3B) (Hennessy et al., 2005, Nat. Rev. Drug Discov. 4:988-1004). Note that the sensitivity and resistance phenotypes shown in FIG. 1 are relative, not absolute. All of the 19 cell lines assayed showed some degree of cell killing in response to inhibition of AKT1/2. Therefore, as expected, all cell lines show a similar direction of regulation post-treatment for these 399 genes, with the more sensitive cell lines showing more robust regulation.

Example 2

Filtering the AKT Signature Gene Set

Figures 4A, 4B, 4C:
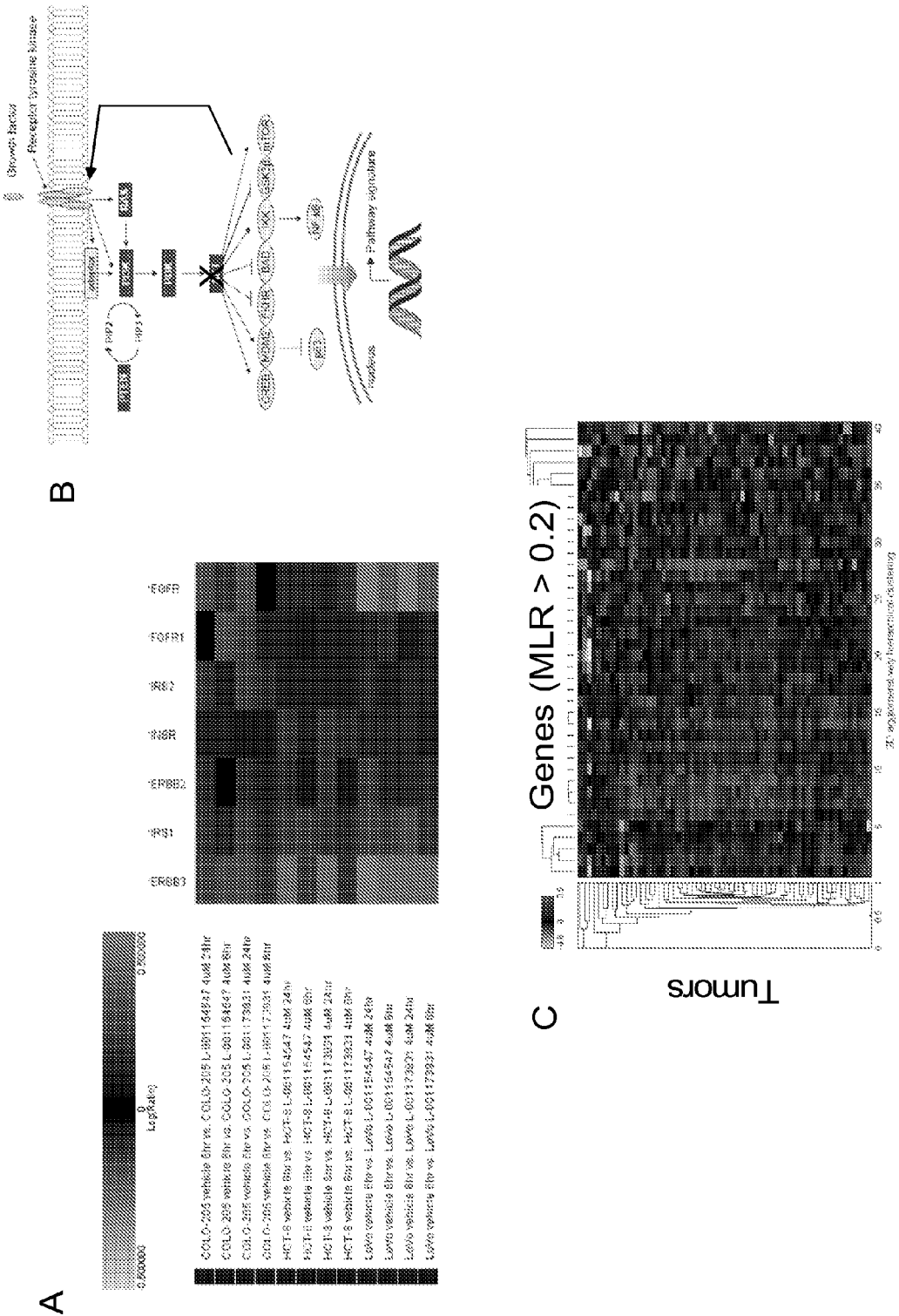

In order to reduce the AKT gene expression signature from 399 genes to a more manageable size, two approaches were taken. First, we eliminated genes involved in "feedback regulation". We defined feedback regulation genes as those that are known to activate AKT signaling, but were upregulated by AKT inhibitors in vitro. For example, ERBB3, IRS1, ERBB2, INSR, IRS2, FGFR1 and EGFR (growth factor pathway components that are known to activate AKT) were upregulated (p<0.5 in at least one experiment) by AKT inhibition in the more sensitive cell lines (COLO205, HCT-8, LoVo) (FIG. 4A). Each of these genes is upstream of AKT, and each is known to lead to activation of PI3K/AKT signaling when they are activated by growth factors. While it may seem counterintuitive that AKT activators would be upregulated by AKT inhibition, it is likely that this upregulation represents the cell's attempt to regain AKT signaling activity after inhibitors are added.

This feedback regulation may be a consequence of short-term, acute inhibition of AKT in vitro (FIG. 4B), and is unlikely to be observed in human tumors that have long term, chronic activation of AKT relative to normal tissue in vivo. For example, while ERBB3, IRS1, ERBB2, INSR, IRS2, FGFR1 and EGFR were upregulated by AKT inhibitors in vitro (i.e. higher in the AKT inhibited state), they are known to be upregulated in many tumors (i.e. higher in a tissue with increased AKT signaling (Hennessy et al., 2005, Nat. Rev. Drug Discov. 4:988-1004). Because we wish to use this signature to assess growth factor pathway activity in human tumors, we focused on genes that show the same direction of regulation in response to AKT pathway modulation in the acute in vitro setting and in the in vivo tumor setting. Our approach was to identify genes that are downregulated by AKT inhibitors in vitro and upregulated, on average, in colon tumors relative to adjacent normal tissues in the colon tumor expression atlas (and vice versa) The colon tumor expression atlas is a database that contains gene expression information on colon cancer. For the colon tumor expression atlas, up to 75 pairs of matched colon tumor and normal (i.e., adjacent non-involving) samples from the same patients were profiled against a pool of a subset of the normal samples. To identify such genes, we created one profile for each tumor sample in the colon tumor expression atlas by re-ratioing each tumor relative to its matched adjacent normal tissue. Starting with the 399 gene expression signature described above, we performed the following operations: for genes that were upregulated by AKT inhibitors in vitro: keep only those that are lower in colon tumors relative to normal tissue (mean log ratio<−0.2 across the tumor set); for genes that were downregulated by AKT inhibitors in vitro: keep only those that are higher in colon tumors relative to normal tissue (mean log ratio>0.2 across the tumor set; see FIG. 4C).

Second, we retained only genes that were regulated (FC>1.2, p<0.05) in all of the 6 hour time point profiles in the more sensitive colon cancer cell lines (HCT-8, LoVo, COLO205) described above. This was done to focus on changes proximal to AKT inhibition, rather than more distal changes which may reflect a more non-specific inhibition of proliferation.

Figures 5A, 5B:
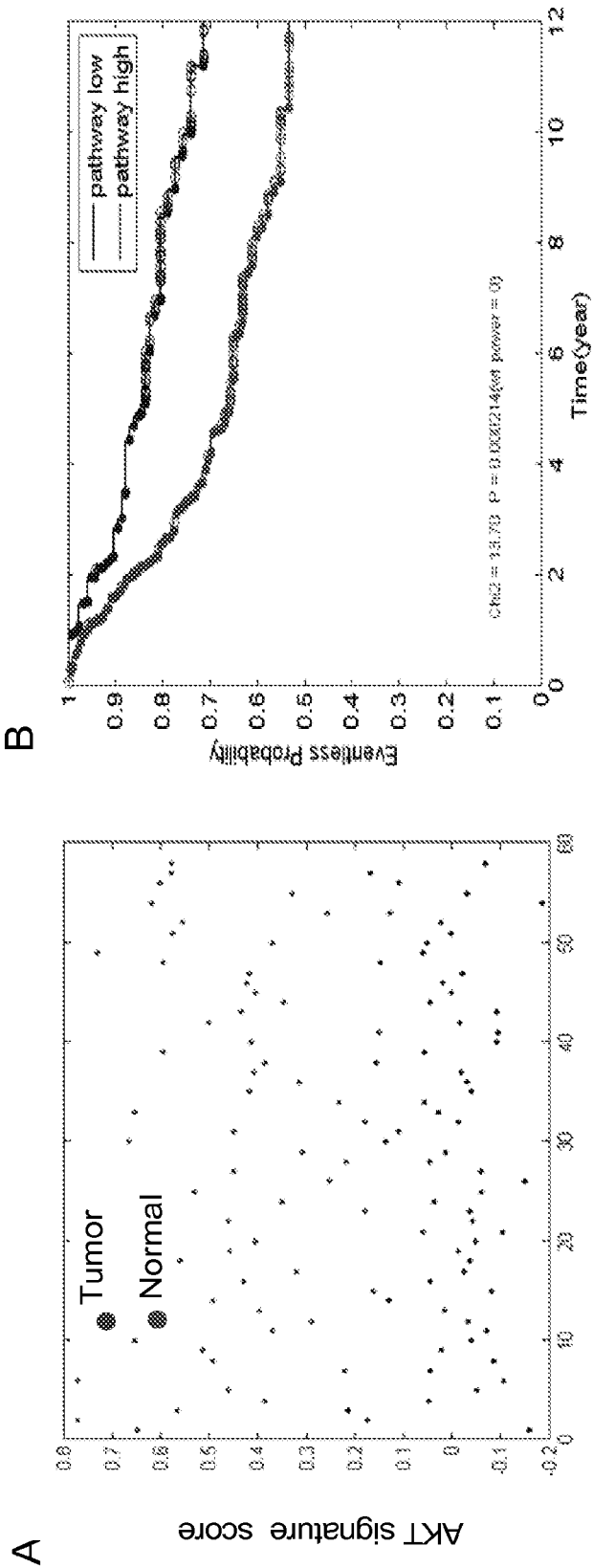

After taking these filtering approaches, we were left with a 48 gene expression signature for AKT signaling activity. Because this AKT signature was generated in colon cancer cells and colon tumors, we next assessed its applicability to breast cancer. We calculated one signature "score" in the breast tumor expression atlas using the following formula: mean log ratio (genes downregulated by AKT inhibition in vitro)−mean log ratio (genes upregulated by AKT inhibition in vitro). The breast tumor expression atlas is a database that contains gene expression information on breast cancer. For the breast tumor expression atlas, up to 75 pairs of matched breast tumor and normal (i.e., adjacent non-involving) samples from the same patients were profiled against a pool of a subset of the normal samples. The AKT signature score is higher in breast tumors compared to adjacent normal tissue (FIG. 5A). This is consistent with evidence showing increased AKT signaling in solid tumors by other methods (Altomare et al., 2003, Cell Biochem. 88:470-476; Cheng et al., 1996, Proc. Natl. Acad. Sci. USA 93:3636-3641; Goel et al., 2004, Cancer Res. 64:3014-3021; Li et al., 1997, Science 275:1943-1947; Li et al, 2005, World J. Gastroenterol. 11:285-288; Ruggeri et al, 1998, Mol. Carcinog. 21:81-86; Staal et al., 1987, Proc. Natl. Acad. Sci. USA 84:5034-5037), and with data showing that phosphorylated AKT levels are a negative prognostic indicator in breast cancer (Vestey et al., 2005, Eur. J. Cancer 41:1017-1025). This suggests that our signature of AKT signaling is an accurate reflection of AKT pathway activation status in human tumors. In order to focus on genes for clinical assay development, we eliminated un-annotated genes with no ascribed function, leaving us with a 37 gene signature: 24 genes that go up with increased AKT signaling activity ("AKT UP"; see Table 1) and 13 genes that go down with increased AKT signaling activity ("AKT DOWN"; see Table 2).

TABLE 1

| AKT pathway signature gene set: Genes that are upregulated with increased AKT pathway activity | | | | |
|---|---|---|---|---|
| Gene Symbol | Gene/Transcript Name | Transcript ID/ Genbank Accessed June ##, 2007 | Transcript SEQ ID NO: | Probe SEQ ID NO: | Protein ID, Genbank Accessed June ##, 2007 |
| DDAH1 | Dimethylarginine dimethylaminohydrolase 1 | NM_012137 | SEQ ID NO: 1 | SEQ ID NO: 2 | NP_036269 |
| RQCD1 | RCD1 required for cell differentiation1 homolog (S. pombe) | BM925206 | SEQ ID NO: 3 | SEQ ID NO: 4 | NP_005435 |
| CSTF2 | Cleavage stimulation factor, 3' pre-RNA, subunit 2, 64 kDa | AK095684 | SEQ ID NO: 5 | SEQ ID NO: 6 | NP_001316 |
| EEF1E1 | Eukaryotic translation elongation factor 1 epsilon 1 | BC005291 | SEQ ID NO: 7 | SEQ ID NO: 8 | NP_004271 |
| PSMA4 | Proteasome (prosome, macropain) subunit, alpha type, 4 | BC030529 | SEQ ID NO: 9 | SEQ 1D NO: 10 | NP_002780 |
| PSMA3 | Proteasome (prosome, macropain) subunit, alpha type, 3 | BM918616 | SEQ ID NO: 11 | SEQ ID NO: 12 | NP_687033 |
| C10orf7 | N/A | NM_006023 | SEQ ID NO: 13 | SEQ ID NO: | NP_006014 |
| PSMB1 | Proteasome (prosome, macropain) subunit, beta type, 1 | AB209078 | SEQ ID NO: 14 | SEQ ID NO: 15 | NP_002784 |
| ODC1 | Ornithine decarboxylase 1 | CR614398 | SEQ ID NO: 16 | SEQ ID NO: 17 | NP_002530 |
| EIF5A | Eukaryotic translation initiation factor 5A | CR622789 | SEQ ID NO: 18 | SEQ ID NO: 19 | NP_001961 |
| UCHL3 | Ubiquitin carboxyl-terminal esterase L3 (ubiquitin thiolesterase) | BF217744 | SEQ ID NO: 20 | SEQ ID NO: 21 | NP_005993 |
| FAM98A | Family with sequence similarity 98, member A | AK096187 | SEQ ID NO: 22 | SEQ ID NO: 23 | NP_056290 |
| PFDN2 | Prefoldin subunit 2 | BF203500 | SEQ ID NO: 24 | SEQ ID NO: 25 | NP_036526 |
| NARG1 | NMDA receptor regulated 1 | NM_057175 | SEQ ID NO: 26 | SEQ ID NO: 27 | NP_476516 |
| EXOSC3 | Exosome component 3 | NM_016042 | SEQ ID NO: 28 | SEQ ID NO: 29 | NP_057126 |
| UBE2V2 | Ubiquitin-conjugating enzyme E2 variant 2 | AK094617 | SEQ ID NO: 30 | SEQ ID NO: 31 | NP_003341 |
| DPH2 | DPH2 homolog (S. cerevisiae) | NM_001384 | SEQ ID NO: 32 | SEQ ID NO: 33 | NP_958801 |
| SLC25A32 | Solute carrier family 25, member 32 | NM_030780 | SEQ ID NO: 34 | SEQ ID NO: 35 | NP_110407 |
| MRPS23 | Mitochondrial ribosomal protein S23 | BE782112 | SEQ ID NO: 36 | SEQ ID NO: 37 | NP_057154 |
| PSMC4 | Proteasome (prosome, macropain) 26S subunit, ATPase, 4 | CR611800 | SEQ ID NO: 38 | SEQ ID NO: 39 | NP_694546 |

TABLE 1-continued

AKT pathway signature gene set: Genes that are upregulated with increased AKT pathway activity

| Gene Symbol | Gene/Transcript Name | Transcript ID/ Genbank Accessed June ##, 2007 | Transcript SEQ ID NO: | Probe SEQ ID NO: | Protein ID, Genbank Accessed June ##, 2007 |
|---|---|---|---|---|---|
| KBTBD6 | Ketch repeat and BTB (POZ) domain containing 6 | NM_152903 | SEQ ID NO: 40 | SEQ ID NO: 41 | NP_690867 |
| SUB1 | SUB1 homolog (S. cerevisiae) | BX537584 | SEQ ID NO: 42 | SEQ ID NO: 43 | NP_006704 |
| NIP7 | Nuclear import 7 homolog (S. cerevisiae) | NM_016101 | SEQ ID NO: 44 | SEQ ID NO: 45 | NP_057185 |
| MRPL50 | Mitochondrial ribosomal protein L50 | BE893534 | SEQ ID NO: 46 | | NP_061924 |

TABLE 2

AKT pathway signature gene set: Genes that are down-regulated with increased AKT pathway activity

| Gene Symbol | Gene/Transcript Name | Transcript ID/ Genbank Accessed June ##, 2007 | Transcript SEQ ID NO: | Probe SEQ ID NO: | Protein ID, Genbank Accessed June ## 2007 |
|---|---|---|---|---|---|
| CTDSP2 | CTD (carboxy-terminal domain, RNA polymerase II, polypeptide A) small phosphatase 2 | NM_005730 | SEQ ID NO: 47 | SEQ ID NO: 48 | NP_005721 |
| CHES1 | Forkhead box N3 | AK055175 | SEQ ID NO: 49 | SEQ ID NO: 50 | NP_005188 |
| CCNG2 | Cyclin G2 | BC032518 | SEQ ID NO: 51 | SEQ ID NO: 52 | NP_004345 |
| APLP2 | Amyloid beta (A4) precursor-like protein 2 | BX647107 | SEQ ID NO: 53 | SEQ ID NO: 54 | NP_001633 |
| SEPP1 | Selenoprotein P, plasma, 1 | BC030009 | SEQ ID NO: 55 | SEQ ID NO: 56 | NP_005401 |
| PPP2R5C | Protein phosphatase 2, regulatory subunit B', gamma isoform | NM_002719 | SEQ ID NO: 57 | SEQ ID NO: 58 | NP_848703 |
| PINK1 | PTEN induced putative kinase 1 | AB053323 | SEQ ID NO: 59 | SEQ ID NO: 60 | NP_115785 |
| LRRC1 | Leucine rich repeat containing 1 | AU119761 | SEQ ID NO: 61 | SEQ ID NO: 62 | NP_079444 |
| MST1 | Macrophage stimulating 1 (hepatocyte growth factor-like) | BC044862 | SEQ ID NO: 63 | SEQ ID NO: 64 | NP_066278 |
| FAM53B | Family with sequence similarity 53, member B | NM_014661 | SEQ ID NO: 65 | SEQ ID NO: 66 | NP_055476 |
| PCK1 | Phosphoenolpyruvate carboxykinase 1 (soluble) | BX648510 | SEQ ID NO: 67 | SEQ ID NO: 68 | NP_002582 |
| TRAK1 | Trafficking protein, kinesin binding 1 | NM_001042646 | SEQ ID NO: 69 | SEQ ID NO: 70 | NP_055780 |
| ZFYVE1 | Zinc finger, FYVE domain containing 1 | BC053520 | SEQ ID NO: 71 | SEQ ID NO: 72 | NP_848535 |

Example 3

Figures 6A, 6B, 6C:
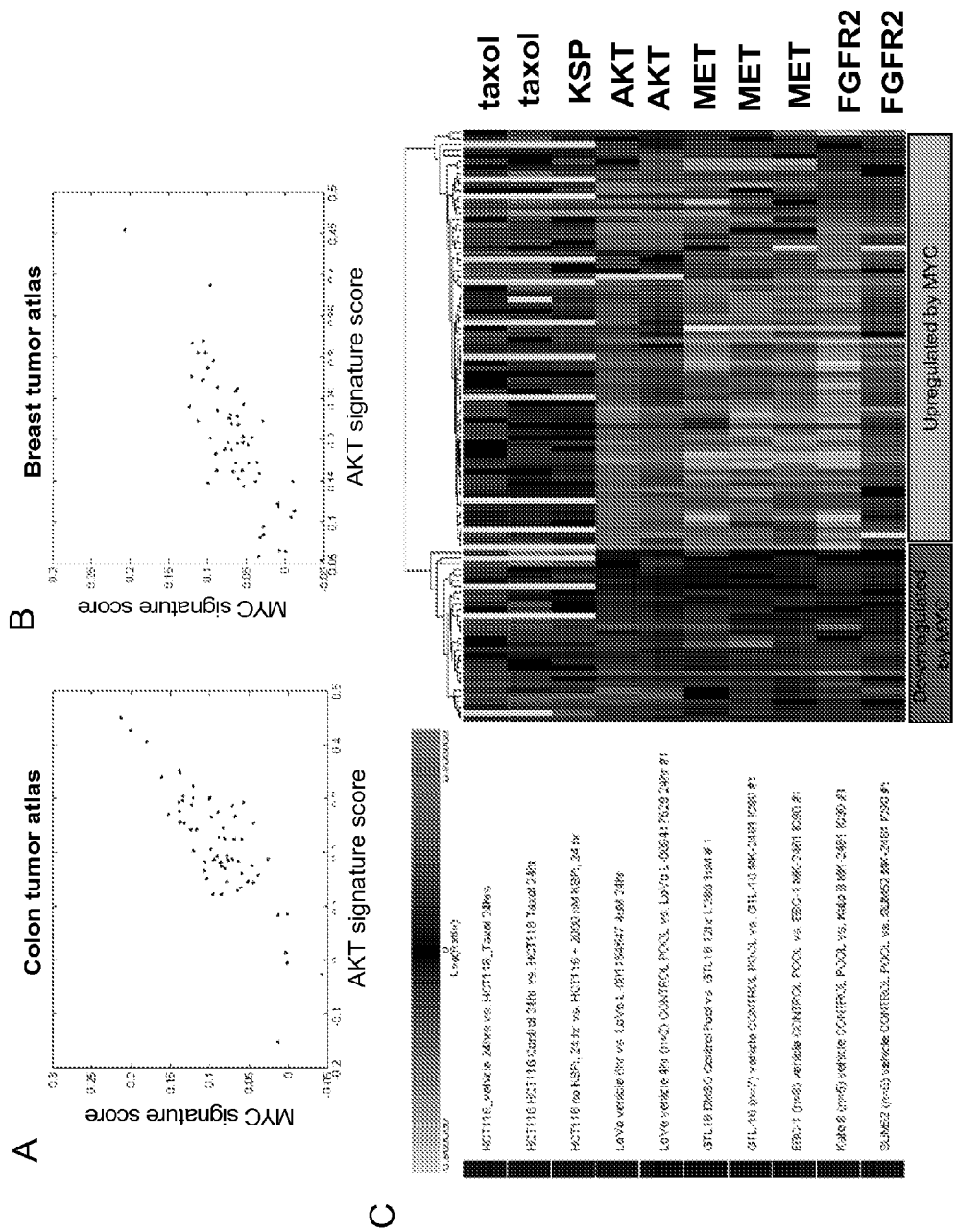

Integration of the MYC Signaling Signature and Development of a Novel MYC Signature Bild et al. published a gene expression signature that was regulated in response to cMYC (also known as MYC) overexpression in primary human mammary epithelial cells (2006, Nature, 439:353-357). This MYC signature was analyzed in the context of tumor expression atlas data. The tumor expression atlas is a collection of gene expression data measured in several different types of human tumors, including breast, colon, gastric, kidney, and lung tumors. For the tumor expression atlas, up to 75 pairs of each type of tumor and normal (i.e., adjacent non-involving) samples from the same patients were profiled against a pool of a subset of the normal samples. Only one gene was shared between the AKT signature and Bild's MYC signature, CCNG2 (Transcript ID BC032518). We also observed that the MYC signature was highly correlated with the AKT signature in the colon and breast tumor expression atlas datasets (FIGS. 6A, B). Therefore, we assessed the regulation of the MYC signature in response to inhibition of AKT and other oncology targets. As shown in FIG. 6C, the MYC signature developed by Bild et al. was robustly and consistently inhibited by small molecule inhibitors targeting AKT, cMET, and FGFR2, but not inhibited by taxol or a KSP small molecule inhibitor. The signatures elicited by cMET, FGFR2, and AKT inhibition were highly similar (data not shown), reflecting their similar mechanism. Therefore, the MYC signature is not a general signature of cell death; rather, it is regulated when growth factor pathway signaling is effected (targeting of growth factor receptor tyrosine kinases or signaling intermediates), but not by mitotic inhibitors.

It has been previously demonstrated that cMYC is a direct target of Notch signaling in T-ALL cells, and that overexpression of cMYC can protect T-cell acute lymphoblastic leukemia/lymphoma (T-ALL) cells from gamma-secretase inhibitor-induced cell death (Weng et al., 2006, Genes Dev. 20:2096-2109). We then assessed the MYC signature developed by Bild et al. in response gamma-secretase inhibition in T-ALL cell lines (DND-41; MOLT-4 (ATCC# CRL-1582); HPB-ALL; KARPAS-45; RPMI-8402; TALL-1; LOUCY (ATCC# CRL-2629)). The T-ALL cell lines were treated with 100 nM or 1 μM gamma-secretase inhibitor 421B for 3 or 7 days. 421B is sulfamide compound (disclosed in Example 75 of U.S. Pat. No. 7,138,400 and WO02/36555). As shown on FIG. 7, inhibition of gamma-secretase resulted in inhibition of the MYC signature in T-ALL cell lines, except for Loucy cells, which do not express MYC. Therefore, in addition to canonical growth factor pathway inhibitors, the MYC signature may be a read out of target inhibitor for gamma secretase inhibitors.

Due to the apparent consistent regulation of the MYC signature by multiple oncology compounds, we took an alternative approach to develop a novel MYC signature. GTL-16 gastric cancer (Giordano, 1989, Nature 339:155-156) and EBC-1 lung cancer cell lines (RIKEN RCB1965) were treated with $IC_{10}$, $IC_{50}$, and $IC_{90}$ doses (for in vitro inhibition of cMET phosphorylation) of cMET inhibitors L-001501404 (4-(6-Phenyl-[1,2,4]-triazolo[4,3-b][1,2,4]triazin-3-ylmethyl)-phenol; see also U.S. Pat. No. 7,122,548); MK-2461 (N-[(2R)-1,4-dioxan-2-ylmethyl]-N-methyl-N'-[3-(1-methyl-1H-pyrazol-4-yl)-5-oxo-5H-benzo[4,5]cyclohepta[1,2-b]pyridin-7-yl]sulfamide; disclosed in PCT application; and L-001793225 (1-[3-(1-Methyl-1H-pyrazol-4-yl)-5-oxo-5H-benzo[4,5]cyclohepta[1,2-b]pyridin-7-yl]-N-(pyridin-2-ylmethyl)methanesulfonamide; disclosed in PCT not yet filed for 12 or 24 hours. To obtain gene expression profiles, total RNA was extracted from the cell samples and amplified using standard protocols (Hughes et al., 2001, Nat. Biotechnol. 19:342-47; Van't Veer et al., 2002, Nature 415:530-36). Expression of about 44,000 human genes was determined by hybridization to 60-mer oligonucleotide arrays (Agilent Technologies, Inc., Santa Clara, Calif.), using Stratagene Universal Human Reference RNA (Stratagene Corporation, La Jolla, Calif.). Gene expression was measured and normalized using standard methods as previously described (Hughes et al., 2001, supra; Van't Veer et al., 2002, supra). Data were normalized to average expression in vehicle only treated cells.

Figure 8A:
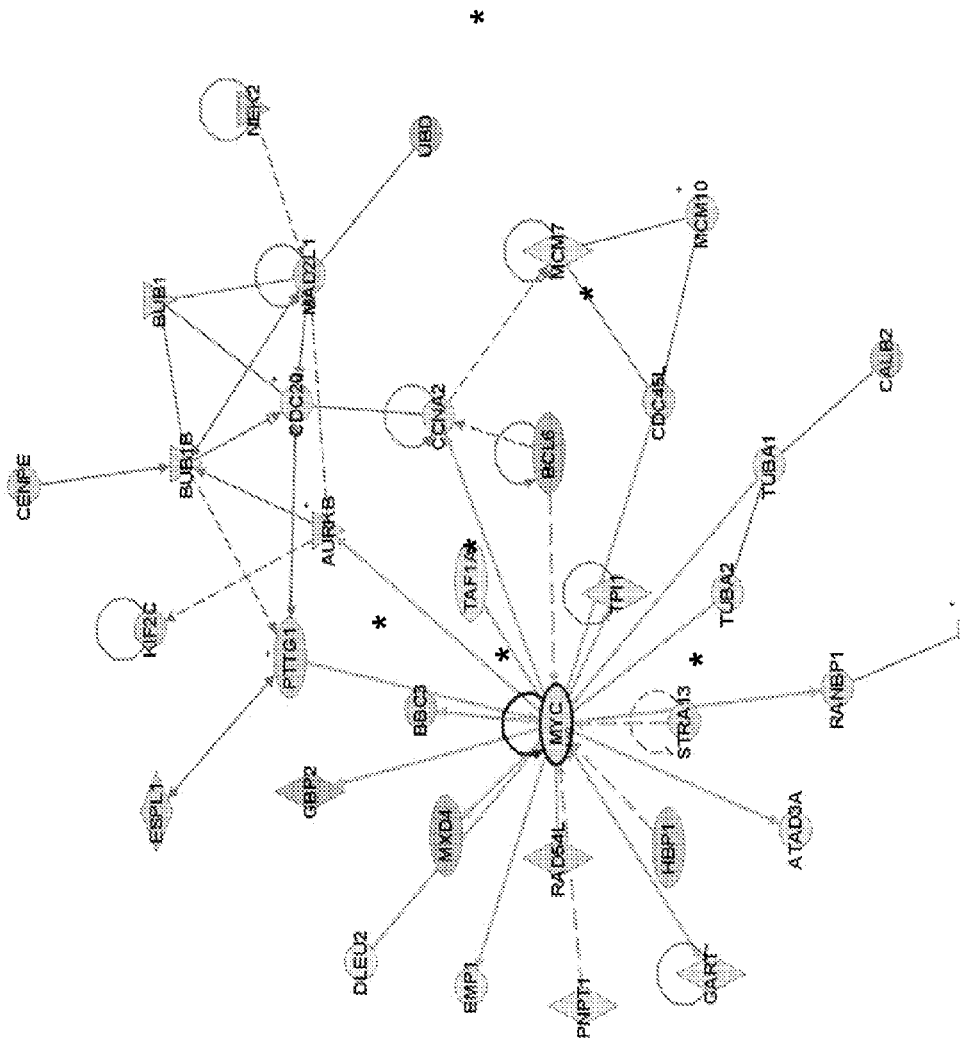
Figure 8B:
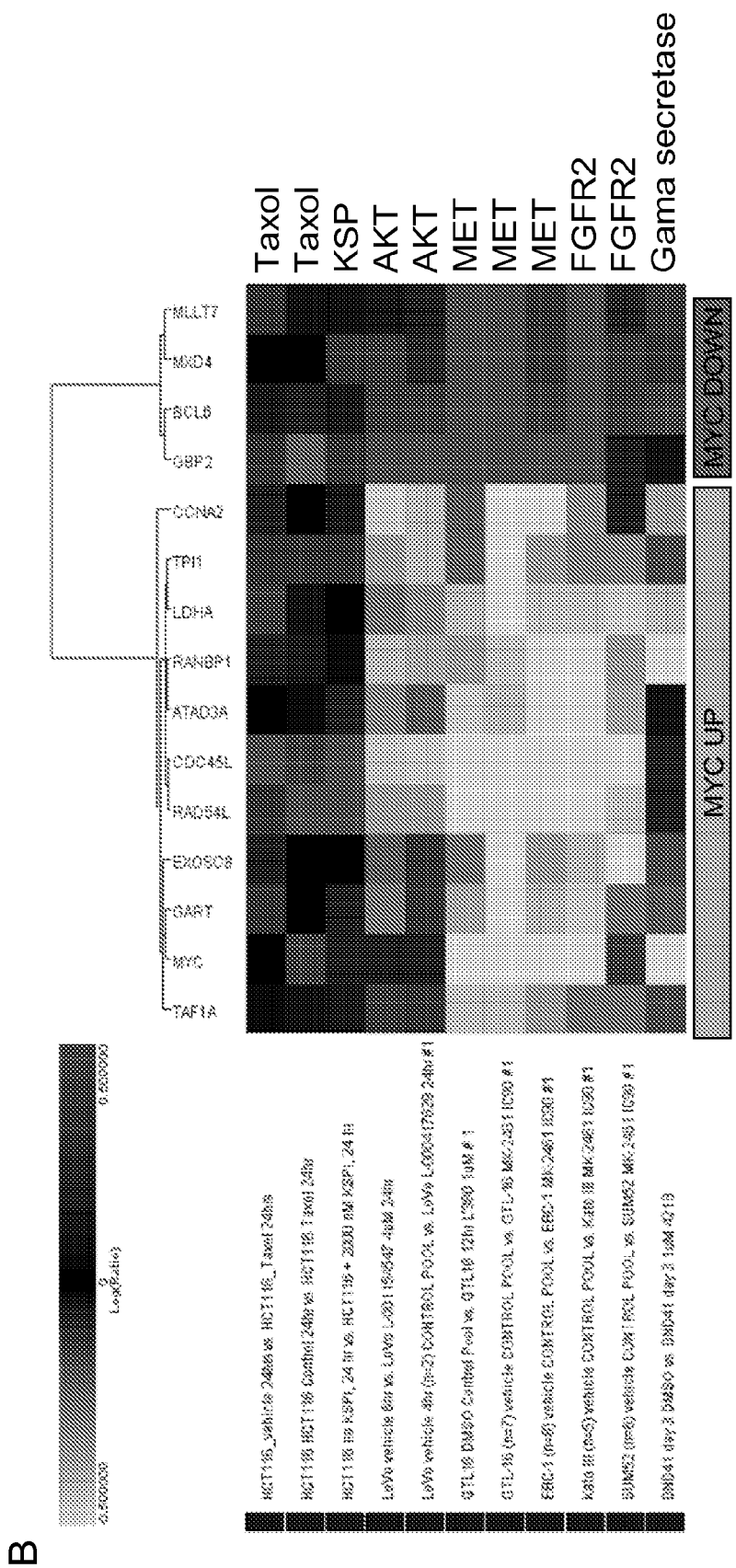

Pathway analysis of the genes showing at least 2-fold change in all $IC_{90}$ samples using the Ingenuity software (Ingenuity Systems, Redwood City, Calif.) showed that MYC was a central hub of the most significant interaction network (FIG. 8A; $p<1\times10^{-64}$). Additionally, analysis using a gene set annotator showed that genes containing MYC promoter elements (Broad Institute promoter motifs database (see also Xie et al., 2005, Nature 434:338-345), E-value=$2.29\times10^{-13}$) were the most significantly enriched group among genes showing at least 2-fold downregulation in all $IC_{90}$ samples (data not shown). Using the Ingenuity interaction created and shown in FIG. 8A, we focused on MYC and the 18 genes known from the scientific literature to interact with MYC in order to create a novel MYC signature. 18 genes were selected based upon fold expression change and the fact that their interaction with MYC was known to be on the transcriptional level, as defined by Ingenuity, rather than a protein-protein interaction. 13 of the MYC signature genes go up with increased MYC signaling ("MYC UP") and 6 of these genes go down with increased MYC signaling ("MYC DOWN"; Table 3). This novel MYC signaling signature is also correlated with the AKT pathway signature in the colon and breast tumor atlas datasets (data not shown), and it is also regulated by growth factor pathway inhibitors and gamma secretase inhibitors, but not by mitotic inhibitors (taxol, KSP inhibitor) (FIG. 8B).

TABLE 3

Novel MYC Signaling Expression Signature Genes - "Up" and "Down" Arms

| Gene Symbol | Gene/Transcript Name | Transcript ID/ Genbank Accessed June ##, 2007 | Transcript SEQ ID NO | Probe SEQ ID NO: | Protein ID, Genbank Accessed June ##, 2007 | Direction of expression with increased MYC signaling |
|---|---|---|---|---|---|---|
| TPI1 | Triosephosphate isomerase 1 | BM913099 | SEQ ID NO: 73 | | NP_000356 | UP |
| CCNA2 | Cyclin A2 | CR604810 | SEQ ID NO: 74 | SEQ ID NO: 75 | NP_001228 | UP |
| GART | Phosphoribosylglycinamide formyltransferase, phosphoribosylglycinamide synthetase, phosphoribosylaminoimidazole synthetase | BC068438 | SEQ ID NO: 76 | SEQ ID NO: 77 | NP_780294 | UP |
| MYC | V-myc myelocytomatosis viral oncogene homolog (avian) | NM_002467 | SEQ ID NO: 78 | SEQ ID NO: 79 | NP_002458 | UP |
| RANBP1 | RAN binding protein 1 | AK094410 | SEQ ID NO: 80 | SEQ ID NO: 81 | NP_002873 | UP |
| CDC45L | CDC45 cell division cycle 45-like (S. cerevisiae) | NM_003504 | SEQ ID NO: 82 | SEQ ID NO: 83 | NP_003495 | UP |

TABLE 3-continued

Novel MYC Signaling Expression Signature Genes - "Up" and "Down" Arms

| Gene Symbol | Gene/Transcript Name | Transcript ID/ Genbank Accessed June ##, 2007 | Transcript SEQ ID NO | Probe SEQ ID NO: | Protein ID, Genbank Accessed June ##, 2007 | Direction of expression with increased MYC signaling |
|---|---|---|---|---|---|---|
| RAD54L | RAD54-like (S. cerevisiae) | NM_003579 | SEQ ID NO: 84 | SEQ ID NO: 85 | NP_003570 | UP |
| ATAD3A | ATPase family, AAA domain containing 3A | AK092833 | SEQ ID NO: 86 | SEQ ID NO: 87 | NP_060658 | UP |
| LDHA | Lactate dehydrogenase A | BM457440 | SEQ ID NO: 88 | SEQ ID NO: 89 | NP_005557 | UP |
| IFRD2 | Interferon-related developmental regulator 2 | Y12395 | SEQ ID NO: 90 | SEQ ID NO: 91 | NP_006755 | UP |
| EXOSC8 | Exosome component 8 | AK096810 | SEQ ID NO: 92 | SEQ ID NO: 93 | NP_852480 | UP |
| DLEU2 | Deleted in lymphocytic leukemia, 2 | AF264787 | SEQ ID NO: 94 | SEQ ID NO: 95 | NP_006012 | UP |
| TAF1A | TATA box binding protein (TBP)-associated factor, RNA polymerase I, A, 48 kDa | NM_005681 | SEQ ID NO: 96 | SEQ ID NO: 97 | NP_647603 | UP |
| BCL6 | B-cell CLL/lymphoma 6 (zinc finger protein 51) | BX649185 | SEQ ID NO: 98 | SEQ ID NO: 99 | NP_620309 | DOWN |
| GBP2 | Guanylate binding protein 2, interferon-inducible | NM_004120 | SEQ ID NO: 100 | SEQ ID NO: 101 | NP_004111 | DOWN |
| MXD4 | MAX dimerization protein 4 | AK024501 | SEQ ID NO: 102 | SEQ ID NO: 103 | NP_006445 | DOWN |
| HBP1 | HMG-box transcription factor 1 | NM_012257 | SEQ ID NO: 104 | SEQ ID NO: 105 | NP_036389 | DOWN |
| MLLT7 | Forkhead box O4 | NM_005938 | SEQ ID NO: 106 | SEQ ID NO: 107 | NP_005929 | DOWN |
| SSBP2 | Single-stranded DNA binding protein 2 | NM_012446 | SEQ ID NO: 108 | SEQ ID NO: 109 | NP_036578 | DOWN |

Example 4

Expansion of the "Growth Factor Signaling Pathway" Signature

As described above, the AKT and MYC signaling signatures are regulated by multiple growth factor pathway inhibitors, but not by mitotic inhibitors. This result suggests that AKT and MYC signaling signatures are likely part of a larger expression signature of growth factor pathway activity, and the genes represented by the AKT and MYC signaling signatures may represent different points along a growth factor signaling axis. Since there are multiple potential targets for inhibition of growth factor pathway signaling, and because of the possibility that ~100 genes could be selected for industrialization and creation of a clinical assay for measurement of signature genes as biomarkers, we expanded our growth factor signaling pathway signature by identifying other genes that are robustly regulated by growth factor pathway inhibitors, but not by mitotic inhibitors.

To identify additional genes for the growth factor signaling pathway signature, the following criteria were used: 1) regulated at least 2-fold (p<0.01) by the $IC_{90}$ dose of MK2461 (cMET inhibitor N-[(2R)-1,4-dioxan-2-ylmethyl]-N-methyl-N'-[3-(1-methyl-1H-pyrazol-4-yl)-5-oxo-5H-benzo[4,5]cyclohepta[1,2-b]pyridin-7-yl]sulfamide) in GTL-16 gastric cancer cells; 2) not regulated by taxol or inhibition of KSP (p>0.05); 3) not part of the AKT or MYC signatures described above. Genes identified using these criteria were further ranked based on fold expression change and responsiveness to inhibition of AKT and FGFR2 in order to identify 26 genes that go up with increasing growth factor signaling activity ("GF UP"; Table 4a), and 19 genes that go down with increasing growth factor signaling activity ("GF DOWN"; Table 4b).

TABLE 4a

Additional Growth Factor Signaling Pathway Signature Genes - GF UP

| Gene Symbol | Gene/Transcript Name | Transcript ID/ Genbank Accessed June ##, 2007 | Transcript SEQ ID NO: | Probe SEQ ID NO: | Protein ID, Genbank Accessed June ##, 2007 |
|---|---|---|---|---|---|
| ATP1B1 | ATPase, Na+/K+ transporting, beta 1 polypeptide | NM_001677 | SEQ ID NO: 110 | SEQ ID NO: 111 | NP_001668 |

TABLE 4a-continued

Additional Growth Factor Signaling Pathway Signature Genes - GF UP

| Gene Symbol | Gene/Transcript Name | Transcript ID/ Genbank Accessed June ##, 2007 | Transcript SEQ ID NO: | Probe SEQ ID NO: | Protein ID, Genbank Accessed June ##, 2007 |
|---|---|---|---|---|---|
| E2F7 | E2F transcription factor 7 | AK096316 | SEQ ID NO: 112 | SEQ ID NO: 113 | NP_976328 |
| UCK2 | Uridine-cytidine kinase 2 | BX640859 | SEQ ID NO: 114 | SEQ ID NO: 115 | NP_036606 |
| CTPS | CTP synthase | BC009408 | SEQ ID NO: 116 | SEQ ID NO: 117 | NP_001896 |
| NOLC1 | Nucleolar and coiled-body phosphoprotein 1 | D21262 | SEQ ID NO: 118 | SEQ ID NO: 119 | NP_004732 |
| MCM7 | Minichromosome maintenance complex component 7 | NM_182776 | SEQ ID NO: 120 | SEQ ID NO: 121 | NP_877577 |
| CDCA4 | Cell division cycle associated 4 | BG354577 | SEQ ID NO: 122 | SEQ ID NO: 123 | NP_663747 |
| MCM10 | Minichromosome maintenance complex component 10 | AL136840 | SEQ ID NO: 124 | SEQ ID NO: 125 | NP_877428 |
| LETM1 | Leucine zipper-EF-hand containing transmembrane protein 1 | BX537709 | SEQ ID NO: 126 | SEQ ID NO: 127 | NP_036450 |
| TRIP13 | Thyroid hormone receptor interactor 13 | NM_004237 | SEQ ID NO: 128 | SEQ ID NO: 129 | NP_004228 |
| HNRPAB | Heterogeneous nuclear ribonucleoprotein A/B | AK123488 | SEQ ID NO: 130 | | NP_112556 |
| NUP155 | Nucleoporin 155 kDa | BC039257 | SEQ ID NO: 131 | SEQ ID NO: 132 | NP_705618 |
| CSE1L | CSE1 chromosome segregation 1-like (yeast) | NM_001316 | SEQ ID NO: 133 | SEQ ID NO: 134 | NP_803185 |
| WDR62 | WD repeat domain 62 | BC058939 | SEQ ID NO: 135 | SEQ ID NO: 136 | NP_775907 |
| SHCBP1 | SHC SH2-domain binding protein 1 | BC030699 | SEQ ID NO: 137 | SEQ ID NO: 138 | NP_079021 |
| DTYMK | Deoxythymidylate kinase (thymidylate kinase) | AF258562 | SEQ ID NO: 139 | SEQ ID NO: 140 | NP_036277 |
| DKC1 | Dyskeratosis congenita 1, dyskerin | BC009928 | SEQ ID NO: 141 | SEQ ID NO: 142 | NP_001354 |
| ZWINT | ZW10 interactor | CR624092 | SEQ ID NO: 143 | SEQ ID NO: 144 | NP_127490 |
| ZWILCH | Zwilch, kinetochore associated, homolog (*Drosophila*) | BX640701 | SEQ ID NO: 145 | SEQ ID NO: 146 | NP_060445 |
| TNFRSF1B | Tumor necrosis factor receptor superfamily, member 1B | BC052977 | SEQ ID NO: 147 | SEQ ID NO: 148 | NP_001057 |
| FABP5 | Fatty acid binding protein 5 (psoriasis-associated) | BM563703 | SEQ ID NO: 149 | | NP_001435 |
| PNPT1 | Polyribonucleotide nucleotidyltransferase 1 | BC053660 | SEQ ID NO: 150 | SEQ ID NO: 151 | NP_149100 |
| TOMM40 | Translocase of outer mitochondrial membrane 40 homolog (yeast) | BC047528 | SEQ ID NO: 152 | SEQ ID NO: 153 | NP_006105 |
| NNMT | Nicotinamide N-methyltransferase | AK097984 | SEQ ID NO: 154 | SEQ ID NO: 155 | NP_006160 |
| HLA-DMB | Major histocompatibility complex, class II, DM beta | AB209577 | SEQ ID NO: 156 | SEQ ID NO: 157 | NP_002109 |
| KIAA1199 | KIAA1199 | AB103330 | SEQ ID NO: 158 | SEQ ID NO: 159 | NP_061159 |

TABLE 4b

Additional Growth Factor Signaling Pathway Signature Genes: GF DOWN

| Gene Symbol | Gene/Transcript Name | Transcript ID/ Genbank Accessed June ##, 2007 | Transcript SEQ ID NO: | Probe SEQ ID NO: | Protein ID, Genbank Accessed June ##, 2007 |
|---|---|---|---|---|---|
| HIST2H2BE | Histone cluster 2, H2be | BC069193 | SEQ ID NO: 160 | SEQ ID NO: 161 | NP_003519 |
| BMF | Bcl2 modifying factor | NM_001003940 | SEQ ID NO: 162 | SEQ ID NO: 163 | NP_277038 |
| GRAMD1C | GRAM domain containing 1C | AL133661 | SEQ ID NO: 164 | SEQ ID NO: 165 | NP_060047 |
| METTL7A | Methyltransferase like 7A | NM_014033 | SEQ ID NO: 166 | SEQ ID NO: 167 | NP_054752 |
| FBXO15 | F-box protein 15 | AK093252 | SEQ ID NO: 168 | SEQ ID NO: 169 | NP_689889 |
| FAM63A | Family with sequence similarity 63, member A | AB037811 | SEQ ID NO: 170 | SEQ ID NO: 171 | NP_060849 |
| FANK1 | Fibronectin type III and ankyrin repeat domains 1 | CR627249 | SEQ ID NO: 172 | SEQ ID NO: 173 | NP_660278 |
| CCT6B | Chaperonin containing TCP1, subunit 6B (zeta 2) | CR933688 | SEQ ID NO: 174 | SEQ ID NO: 175 | NP_006575 |
| ING4 | Inhibitor of growth family, member 4 | NM_016162 | SEQ ID NO: 176 | SEQ ID NO: 177 | NP_938028 |
| YPEL2 | Yippee-like 2 (*Drosophila*) | NM_001005404 | SEQ ID NO: 178 | SEQ ID NO: 179 | NP_001005404 |
| PCDHB14 | Protocadherin beta 14 | BC050417 | SEQ ID NO: 180 | SEQ ID NO: 181 | NP_061757 |
| KLHL24 | Kelch-like 24 (*Drosophila*) | NM_017644 | SEQ ID NO: 182 | SEQ ID NO: 183 | NP_060114 |
| PNRC1 | Proline-rich nuclear receptor coactivator 1 | NM_006813 | SEQ ID NO: 184 | SEQ ID NO: 185 | NP_006804 |
| TMC4 | Transmembrane channel-like 4 | BC025323 | SEQ ID NO: 186 | SEQ ID NO: 187 | NP_653287 |
| HHAT | Hedgehog acyltransferase | BC051191 | SEQ ID NO: 188 | SEQ ID NO: 189 | NP_050664 |
| CHGB | Chromogranin B (secretogranin 1) | BC000375 | SEQ ID NO: 190 | SEQ ID NO: 191 | NP_001810 |
| ARNT2 | Aryl-hydrocarbon receptor nuclear translocator 2 | NM_014862 | SEQ ID NO: 192 | SEQ ID NO: 193 | NP_055677 |
| ACSS1 | Acyl-CoA synthetase short-chain family member 1 | AK125058 | SEQ ID NO: 194 | SEQ ID NO: 195 | NP_115890 |
| GSTA2 | Glutathione S-transferase A2 | BI762502 | SEQ ID NO: 196 | SEQ ID NO: 197 | NP_000837 |

The final result of the above described analyses is a 101 gene signature that reflects the activity of growth factor signaling pathways in tumors (Table 5). This gene signature is split into two opposing arms—the "up" arm (Table 5a), comprising of genes that are upregulated, and the "down" arm (Table 5b), comprising of genes that are downregulated, as signaling through the growth factor pathway increases.

TABLE 5a

63 genes of the "Up" arm of gene expression signature for Growth Factor Pathway Signaling

| Gene Symbol | Gene/Transcript Name | Transcript ID/ Genbank Accessed June ##, 2007 | Transcript SEQ ID NO: | Probe SEQ ID NO: | Protein ID, Genbank Accessed June ##, 2007 | Direction of expression with increasing growth factor signaling activity |
|---|---|---|---|---|---|---|
| DDAH1 | Dimethylarginine dimethylaminohydrolase 1 | NM_012137 | 1 | 2 | NP_036269 | UP |
| RQCD1 | RCD1 required for cell differentiation1 homolog (*S. pombe*) | BM925206 | 3 | 4 | NP_005435 | UP |
| CSTF2 | Cleavage stimulation factor, 3' pre-RNA, subunit 2, 64 kDa | AK095684 | 5 | 6 | NP_001316 | UP |
| EEF1E1 | Eukaryotic translation elongation factor 1 epsilon 1 | BC005291 | 7 | 8 | NP_004271 | UP |

TABLE 5a-continued 63 genes of the "Up" arm of gene expression signature for Growth Factor Pathway Signaling

| Gene Symbol | Gene/Transcript Name | Transcript ID/ Genbank Accessed June ##, 2007 | Transcript SEQ ID NO: | Probe SEQ ID NO: | Protein ID, Genbank Accessed June ##, 2007 | Direction of expression with increasing growth factor signaling activity |
|---|---|---|---|---|---|---|
| PSMA4 | Proteasome (prosome, macropain) subunit, alpha type, 4 | BC030529 | 9 | 10 | NP_002780 | UP |
| PSMA3 | Proteasome (prosome, macropain) subunit, alpha type, 3 | BM918616 | 11 | 12 | NP_687033 | UP |
| C10orf7 | N/A | NM_006023 | 13 | | NP_006014 | UP |
| PSMB1 | Proteasome (prosome, macropain) subunit, beta type, 1 | AB209078 | 14 | 15 | NP_002784 | UP |
| ODC1 | Ornithine decarboxylase 1 | CR614398 | 16 | 17 | NP_002530 | UP |
| EIF5A | Eukaryotic translation initiation factor 5A | CR622789 | 18 | 19 | NP_001961 | UP |
| UCHL3 | Ubiquitin carboxyl-terminal esterase L3 (ubiquitin thiolesterase) | BF217744 | 20 | 21 | NP_005993 | UP |
| FAM98A | Family with sequence similarity 98, member A | AK096187 | 22 | 23 | NP_056290 | UP |
| PFDN2 | Prefoldin subunit 2 | BF203500 | 24 | 25 | NP_036526 | UP |
| NARG1 | NMDA receptor regulated 1 | NM_057175 | 26 | 27 | NP_476516 | UP |
| EXOSC3 | Exosome component 3 | NM_016042 | 28 | 29 | NP_057126 | UP |
| UBE2V2 | Ubiquitin-conjugating enzyme E2 variant 2 | AK094617 | 30 | 31 | NP_003341 | UP |
| DPH2 | DPH2 homolog (*S. cerevisiae*) | NM_001384 | 32 | 33 | NP_958801 | UP |
| SLC25A32 | Solute carrier family 25, member 32 | NM_030780 | 34 | 35 | NP_110407 | UP |
| MRPS23 | Mitochondrial ribosomal protein S23 | BE782112 | 36 | 37 | NP_057154 | UP |
| PSMC4 | Proteasome (prosome, macropain) 26S subunit, ATPase, 4 | CR611800 | 38 | 39 | NP_694546 | UP |
| KBTBD6 | Kelch repeat and BTB (POZ) domain containing 6 | NM_152903 | 40 | 41 | NP_690867 | UP |
| SUB1 | SUB1 homolog (*S. cerevisiae*) | BX537584 | 42 | 43 | NP_006704 | UP |
| NIP7 | Nuclear import 7 homolog (*S. cerevisiae*) | NM_016101 | 44 | 45 | NP_057185 | UP |
| MRPL50 | Mitochondrial ribosomal protein L50 | BE893534 | 46 | | NP_061924 | UP |
| TPI1 | Triosephosphate isomerase 1 | BM913099 | 73 | | NP_000356 | UP |
| CCNA2 | Cyclin A2 | CR604810 | 74 | 75 | NP_001228 | UP |
| GART | Phosphoribosylglycinamide formyltransferase, phosphoribosylglycinamide synthetase, phosphoribosylaminoimidazole synthetase | BC068438 | 76 | 77 | NP_780294 | UP |
| MYC | V-myc myelocytomatosis viral oncogene homolog (avian) | NM_002467 | 78 | 79 | NP_002458 | UP |
| RANBP1 | RAN binding protein 1 | AK094410 | 80 | 81 | NP_002873 | UP |
| CDC45L | CDC45 cell division cycle 45-like (*S. cerevisiae*) | NM_003504 | 82 | 83 | NP_003495 | UP |
| RAD54L | RAD54-like (*S. cerevisiae*) | NM_003579 | 84 | 85 | NP_003570 | UP |
| ATAD3A | ATPase family, AAA domain containing 3A | AK092833 | 86 | 87 | NP_060658 | UP |
| LDHA | Lactate dehydrogenase A | BM457440 | 88 | 89 | NP_005557 | UP |
| IFRD2 | Interferon-related developmental regulator 2 | Y12395 | 90 | 91 | NP_006755 | UP |
| EXOSC8 | Exosome component 8 | AK096810 | 92 | 93 | NP_852480 | UP |
| DLEU2 | Deleted in lymphocytic leukemia, 2 | AF264787 | 94 | 95 | NP_006012 | UP |
| TAF1A | TATA box binding protein (TBP)-associated factor, RNA polymerase I, A, 48 kDa | NM_005681 | 96 | 97 | NP_647603 | UP |

TABLE 5a-continued 63 genes of the "Up" arm of gene expression signature for Growth Factor Pathway Signaling

| Gene Symbol | Gene/Transcript Name | Transcript ID/ Genbank Accessed June ##, 2007 | Transcript SEQ ID NO: | Probe SEQ ID NO: | Protein ID, Genbank Accessed June ##, 2007 | Direction of expression with increasing growth factor signaling activity |
|---|---|---|---|---|---|---|
| ATP1B1 | ATPase, Na+/K+ transporting, beta 1 polypeptide | NM_001677 | 110 | 111 | NP_001668 | UP |
| E2F7 | E2F transcription factor 7 | AK096316 | 112 | 113 | NP_976328 | UP |
| UCK2 | Uridine-cytidine kinase 2 | BX640859 | 114 | 115 | NP_036606 | UP |
| CTPS | CTP synthase | BC009408 | 116 | 117 | NP_001896 | UP |
| NOLC1 | Nucleolar and coiled-body phosphoprotein 1 | D21262 | 118 | 119 | NP_004732 | UP |
| MCM7 | Minichromosome maintenance complex component 7 | NM_182776 | 120 | 121 | NP_877577 | UP |
| CDCA4 | Cell division cycle associated 4 | BG354577 | 122 | 123 | NP_663747 | UP |
| MCM10 | Minichromosome maintenance complex component 10 | AL136840 | 124 | 125 | NP_877428 | UP |
| LETM1 | Leucine zipper-EF-hand containing transmembrane protein 1 | BX537709 | 126 | 127 | NP_036450 | UP |
| TRIP13 | Thyroid hormone receptor interactor 13 | NM_004237 | 128 | 129 | NP_004228 | UP |
| HNRPAB | Heterogeneous nuclear ribonucleoprotein A/B | AK123488 | 130 | | NP_112556 | UP |
| NUP155 | Nucleoporin 155 kDa | BC039257 | 131 | 132 | NP_705618 | UP |
| CSE1L | CSE1 chromosome segregation 1-like (yeast) | NM_001316 | 133 | 134 | NP_803185 | UP |
| WDR62 | WD repeat domain 62 | BC058939 | 135 | 136 | NP_775907 | UP |
| SHCBP1 | SHC SH2-domain binding protein 1 | BC030699 | 137 | 138 | NP_079021 | UP |
| DTYMK | Deoxythymidylate kinase (thymidylate kinase) | AF258562 | 139 | 140 | NP_036277 | UP |
| DKC1 | Dyskeratosis congenita 1, dyskerin | BC009928 | 141 | 142 | NP_001354 | UP |
| ZWINT | ZW10 interactor | CR624092 | 143 | 144 | NP_127490 | UP |
| ZWILCH | Zwilch, kinetochore associated, homolog (*Drosophila*) | BX640701 | 145 | 146 | NP_060445 | UP |
| TNFRSF1B | Tumor necrosis factor receptor superfamily, member 1B | BC052977 | 147 | 148 | NP_001057 | UP |
| FABP5 | Fatty acid binding protein 5 (psoriasis-associated) | BM563703 | 149 | | NP_001435 | UP |
| PNPT1 | Polyribonucleotide nucleotidyltransferase 1 | BC053660 | 150 | 151 | NP_149100 | UP |
| TOMM40 | Translocase of outer mitochondrial membrane 40 homolog (yeast) | BC047528 | 152 | 153 | NP_006105 | UP |
| NNMT | Nicotinamide N-methyltransferase | AK097984 | 154 | 155 | NP_006160 | UP |
| HLA-DMB | Major histocompatibility complex, class II, DM beta | AB209577 | 156 | 157 | NP_002109 | UP |
| KIAA1199 | KIAA1199 | AB103330 | 158 | 159 | NP_061159 | UP |

TABLE 5b 38 genes of "Down" Arm of gene expression signature for Growth Factor Pathway Signaling

| Gene Symbol | Gene/Transcript Name | Transcript ID/ Genbank Accessed June ##, 2007 | Transcript SEQ ID NO: | Probe SEQ ID NO: | Protein ID, Genbank Accessed June ##, 2007 | Direction of expression with increasing growth factor signaling activity |
|---|---|---|---|---|---|---|
| CTDSP2 | CTD (carboxy-terminal domain, RNA polymerase II, polypeptide A) small phosphatase 2 | NM_005730 | 47 | 48 | NP_005721 | DOWN |
| CHES1 | Forkhead box N3 | AK055175 | 49 | 50 | NP_005188 | DOWN |
| CCNG2 | Cyclin G2 | BC032518 | 51 | 52 | NP_004345 | DOWN |
| APLP2 | Amyloid beta (A4) precursor-like protein 2 | BX647107 | 53 | 54 | NP_001633 | DOWN |
| SEPP1 | Selenoprotein P, plasma, 1 | BC030009 | 55 | 56 | NP_005401 | DOWN |
| PPP2R5C | Protein phosphatase 2, regulatory subunit B', gamma isoform | NM_002719 | 57 | 58 | NP_848703 | DOWN |
| PINK1 | PTEN induced putative kinase 1 | AB053323 | 59 | 60 | NP_115785 | DOWN |
| LRRC1 | Leucine rich repeat containing 1 | AU119761 | 61 | 62 | NP_079444 | DOWN |
| MST1 | Macrophage stimulating 1 (hepatocyte growth factor-like) | BC044862 | 63 | 64 | NP_066278 | DOWN |
| FAM53B | Family with sequence similarity 53, member B | NM_014661 | 65 | 66 | NP_055476 | DOWN |
| PCK1 | Phosphoenolpyruvate carboxykinase 1 (soluble) | BX648510 | 67 | 68 | NP_002582 | DOWN |
| TRAK1 | Trafficking protein, kinesin binding 1 | NM_001042646 | 69 | 70 | NP_055780 | DOWN |
| ZFYVE1 | Zinc finger, FYVE domain containing 1 | BC053520 | 71 | 72 | NP_848535 | DOWN |
| BCL6 | B-cell CLL/lymphoma 6 (zinc finger protein 51) | BX649185 | 98 | 99 | NP_620309 | DOWN |
| GBP2 | Guanylate binding protein 2, interferon-inducible | NM_004120 | 100 | 101 | NP_004111 | DOWN |
| MXD4 | MAX dimerization protein 4 | AK024501 | 102 | 103 | NP_006445 | DOWN |
| HBP1 | HMG-box transcription factor 1 | NM_012257 | 104 | 105 | NP_036389 | DOWN |
| MLLT7 | Forkhead box O4 | NM_005938 | 106 | 107 | NP_005929 | DOWN |
| SSBP2 | Single-stranded DNA binding protein 2 | NM_012446 | 108 | 109 | NP_036578 | DOWN |
| HIST2H2BE | Histone cluster 2, H2be | BC069193 | 160 | 161 | NP_003519 | DOWN |
| BMF | Bcl2 modifying factor | NM_001003940 | 162 | 163 | NP_277038 | DOWN |
| GRAMD1C | GRAM domain containing 1C | AL133661 | 164 | 165 | NP_060047 | DOWN |
| METTL7A | Methyltransferase like 7A | NM_014033 | 166 | 167 | NP_054752 | DOWN |
| FBXO15 | F-box protein 15 | AK093252 | 168 | 169 | NP_689889 | DOWN |
| FAM63A | Family with sequence similarity 63, member A | AB037811 | 170 | 171 | NP_060849 | DOWN |
| FANK1 | Fibronectin type III and ankyrin repeat domains 1 | CR627249 | 172 | 173 | NP_660278 | DOWN |
| CCT6B | Chaperonin containing TCP1, subunit 6B (zeta 2) | CR933688 | 174 | 175 | NP_006575 | DOWN |
| ING4 | Inhibitor of growth family, member 4 | NM_016162 | 176 | 177 | NP_938028 | DOWN |
| YPEL2 | Yippee-like 2 (*Drosophila*) | NM_001005404 | 178 | 179 | NP_001005404 | DOWN |
| PCDHB14 | Protocadherin beta 14 | BC050417 | 180 | 181 | NP_061757 | DOWN |
| KLHL24 | Kelch-like 24 (*Drosophila*) | NM_017644 | 182 | 183 | NP_060114 | DOWN |
| PNRC1 | Proline-rich nuclear receptor coactivator 1 | NM_006813 | 184 | 185 | NP_006804 | DOWN |
| TMC4 | Transmembrane channel-like 4 | BC025323 | 186 | 187 | NP_653287 | DOWN |
| HHAT | Hedgehog acyltransferase | BC051191 | 188 | 189 | NP_060664 | DOWN |

TABLE 5b-continued 38 genes of "Down" Arm of gene expression signature for Growth Factor Pathway Signaling

| Gene Symbol | Gene/Transcript Name | Transcript ID/ Genbank Accessed June ##, 2007 | Transcript SEQ ID NO: | Probe SEQ ID NO: | Protein ID, Genbank Accessed June ##, 2007 | Direction of expression with increasing growth factor signaling activity |
|---|---|---|---|---|---|---|
| CHGB | Chromogranin B (secretogranin 1) | BC000375 | 190 | 191 | NP_001810 | DOWN |
| ARNT2 | Aryl-hydrocarbon receptor nuclear translocator 2 | NM_014862 | 192 | 193 | NP_055677 | DOWN |
| ACSS1 | Acyl-CoA synthetase short-chain family member 1 | AK125058 | 194 | 195 | NP_115890 | DOWN |
| GSTA2 | Glutathione S-transferase A2 | BI762502 | 196 | 197 | NP_000837 | DOWN |

Example 5

Inverse Regulation of the Growth Factor Signaling Pathway Signature by Small Molecule Inhibitors and Growth Factors Because we developed this novel growth factor signaling pathway signature based on regulation by inhibitors of growth factor pathway signaling, we hypothesized that our signature genes would be inversely regulated in vitro by treatments that activate growth factor signaling. Multiple cell lines (SKMC (skeletal muscle), MCF7 (breast cancer), HT29 (colon cancer), and HMEC (mammary epithelial cells) were profiled after treatment with 5 growth factors (heregulin, insulin, IGF, FGF, EGF) for 0.5, 2, 6, 18, or 24 hours. As shown in FIG. 9, the growth factor pathway signature is inversely regulated by growth factors compared to inhibitors of growth factor pathway signaling. Genes that are upregulated by growth factor inhibitors are downregulated by growth factors, and vice versa, with regulation observed as early as 2 hours post-treatment with growth factors. In addition, signature genes did not show consistent regulation by mitotic inhibitors. These results provide further evidence that this signature is not a general signature of proliferation or cell death; rather, the signature apparently reflects events more proximal and specific to the activity of growth factor pathway signals.

Example 6

Prediction of Response to cMET Inhibitor by Growth Factor Signaling Pathway Signature or cMET mRNA Expression Fourteen tumor lines were tested for sensitivity to cMET inhibitor MK-2461. Tumors were tested in a colony-formation assay in which the ability of tumors seeded in soft agar to form colonies was tested. Samples were treated with varying doses of MK-2461 and the inhibitory effect of MK-2461 on colony formation was assessed. The $IC_{50}$ dose of MK-2461 that resulted in a 50% reduction in colony formation relative to vehicle treatment was determined. Gene expression profiling was also performed on each tumor line.

Figure 11A:
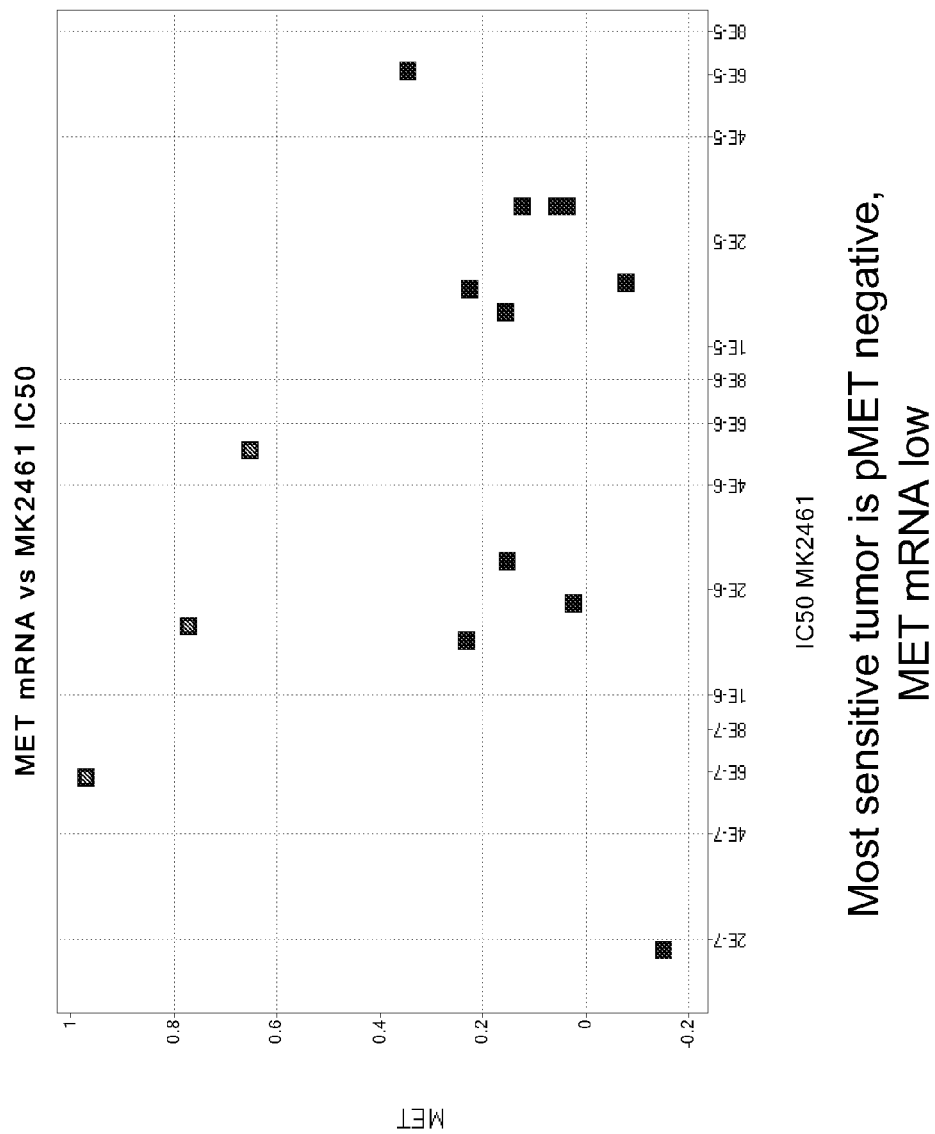
Figure 11B:
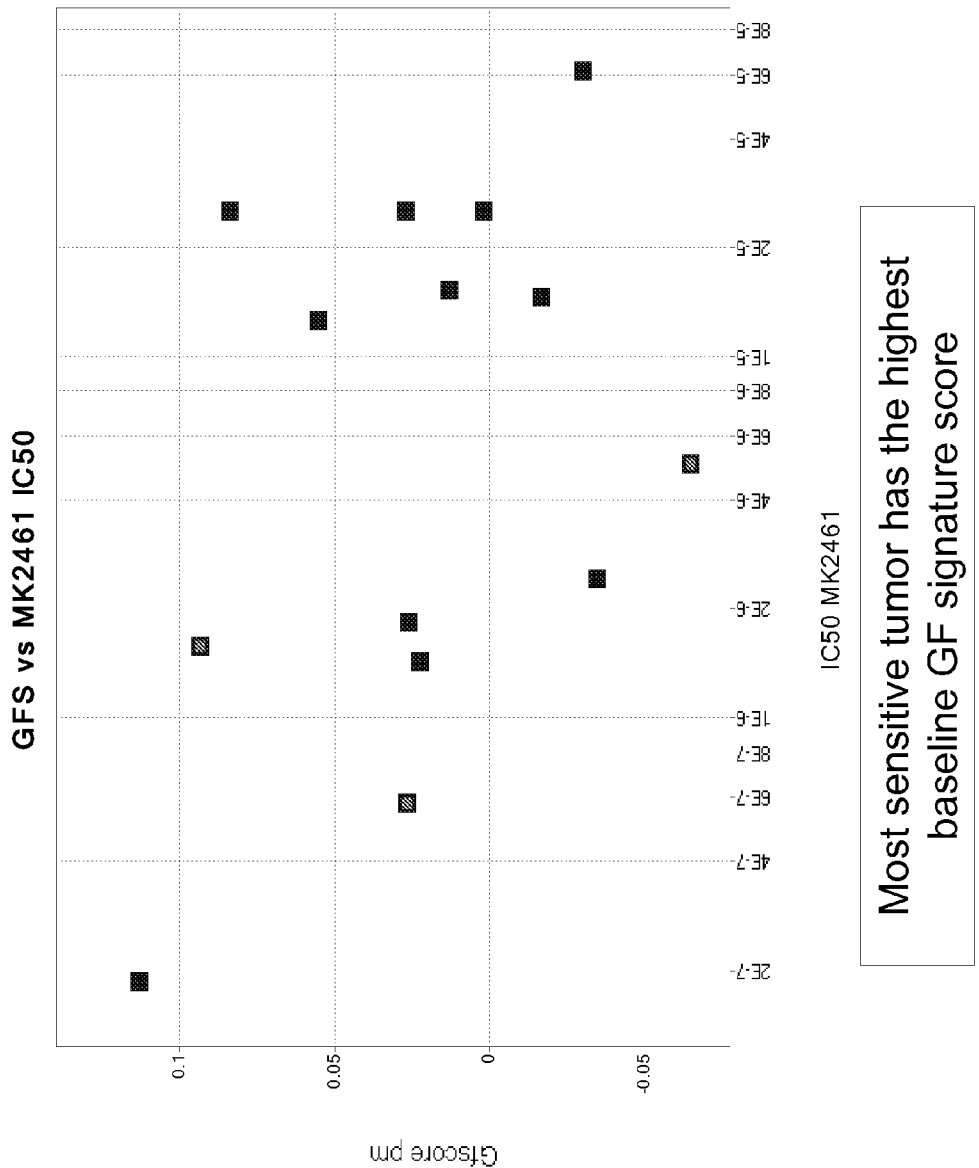

The ability of mRNA expression of cMET to predict MK-2461 response was assessed. As shown in FIG. 11A, the tumor that was the most sensitive to MK-2461 treatment had low expression of cMET. However, as shown in FIG. 11B, the most sensitive tumor had the highest baseline growth factor signaling pathway signature score. Harvesting RNA from both vehicle-treated and compound-treated tumor lines, regulation of the growth factor signaling pathway by MK-2461 was assessed by comparing gene expression profiles of MK-2461 treated cells to vehicle treated cells. For every probe on the microarray, log(10) ratio of expression in the MK-2461 treated cells relative to the matched vehicle treated cells was calculated. The growth factor signaling pathway signature score was calculated as the mean log(10) ratio of the genes in the "up" arm of the signature (see Table 5a) minus the mean log(10) ratio of the genes in the "down" arm of the signature (see Table 5b). These data suggest that the growth factor signaling pathway signature is a better predictor of MK-2461 sensitivity than mRNA expression of cMET and that the signature could be used to predict response to treatment with MK-2461.

Example 7

Growth Factor Signaling Pathway Signature as an Early Readout of Compound Efficacy in Cell Lines Ten cell lines with alternations of the PI3K/MAPK pathway components were identified (see Table 6), including two cell lines with amplification of cMET (EBC-1 and GTL-16). Previous work had demonstrated that among the ten cell lines listed in Table 6, only EBC-1 and GTL-16 were sensitive to cell killing in response to treatment with cMET inhibitor MK-2461 (data not shown). To assess the regulation of the growth factor signaling pathway signature in these cells, these cell lines were treated with vehicle or 1 μM MK-2461. The cell lines were profiled at 6 and 12 hours post-treatment. Duplicate cultures were seeded in 6-well plates for each treatment group. Cell were ~70% confluent at time of collection. Experiments were performed in duplicate.

TABLE 6

Cell lines with alterations in the PI3K/MAPK pathway.

| cell line | PTEN | PI3KCA mutation | Ras mutation | AKT amplification | MET amplification | Braf mutation | sensitive to MK2461 | sensitive to AKTi |
|---|---|---|---|---|---|---|---|---|
| HCT116 | ? | | + | | | | no | |
| HCT15 (or AGS) | ? | | + | | | | no | |
| A549 | + | | + | | | | no | |
| HT29 | + | | | | | + | no | |
| Colo205 | | | | | | + | no | |
| MCF7 | + | + | | | | | | ✓ |
| PC3 | − | | | | | | | |
| LnCap | − | | | | | | | ✓ |
| EBC-1 | ? | | | | + | | ✓ | |
| GTL-16 | ? | | | | + | | ✓ | |

RNA was harvested from both vehicle-treated and compound treated cells, and regulation of the growth factor signaling pathway by MK-2461 was assessed by comparing gene expression profiles of MK-2461 treated cells to vehicle treated cells. For every probe on the microarray, the log(10) ratio of expression in the MK-2461 treated samples relative to the cell line-matched vehicle treated samples was calculated. The growth factor signaling pathway signature score was calculated as the mean log(10) ratio of the genes in the "up" arm of the signature (see Table 5a) minus the mean log(10) ratio of the genes in the "down" arm of the signature (see Table 5b). As shown in FIG. 12, inhibition of the growth factor signaling pathway was only observed in two cell lines, EBC-1 and GTL-16. Because these are the only two cell lines sensitive to MK-2461, these data suggest that the growth factor signaling pathway signature could be used as an early readout of efficacy.

Example 8

Growth Factor Signaling Pathway Signature as an Early Readout of Compound Efficacy in Xenografts HRLN female nu/nu mice were subcutaneously implanted with 5×10⁶ EBC-1 tumor cells. Tumors were allowed to grow an average size of 450-500 mg before treatment was administered. Xenografts were treated with vehicle or 11, 34, or 112 mpk of MK-2461 (n=4 for each treatment group). Previous data demonstrated that only the 112 mpk dose had any effect on tumor growth (data not shown). Treatment with 112 mpk MK-2461 resulted in approximately 30% tumor growth inhibition compared to vehicle treatment. Treatment with 11 mpk and 34 mpk MK-2461 had no effect on tumor growth. Treatment was administered PO BID for 7 days. Tumors were harvested 2 hours after the final dose, as this was the estimated time to achieve $C_{max}$.

RNA was harvested from both vehicle-treated and compound-treated samples. Regulation of the growth factor signaling pathway signature by MK-2461 was assessed by comparing gene expression profiles of MK-2461 treated samples to the mean gene expression profile of the 4 vehicle treated samples. The log(10) ratio of expression in the MK-2461 treated samples relative to the mean of the vehicle treated samples was calculated for every probe on the microarray. The growth factor signaling pathway signature score was calculated as the mean log(10) ratio of the genes in the "up" arm of the signature (see Table 5a) minus the mean log(10) ratio of the genes in the "down" arm of the signature (see Table 5b).

As shown in FIG. 13, inhibition of the growth factor signaling pathway signature was only observed at the 112 mpk dose. Because this was the only dose that resulted in efficacy, these data suggest that the growth factor signaling pathway signature could be used as an early readout of efficacy.

Example 9

Validation and Refinement of the Growth Factor Pathway Signaling Gene Signature The gene signature for the growth factor signaling pathway is split into two opposing arms, the "up" arm (Table 5a), which is upregulated, and the "down" arm (Table 5b), which is downregulated, as signaling through the growth factor pathway increases. The purpose of coherence analysis is to show the statistical significance between the "up" and "down" arms of the signature in a new dataset. Two correlation coefficients were calculated for all of the genes in both the "up" and "down" arms of Tables 5a and 5b. First, the correlation between each gene in the "up" arm and the average of all the genes in the "up" arm is calculated. Second, the anti-correlation between each gene in the "up" arm and the average of all genes in the "down" arm is calculated. This process is also repeated for the genes in the "down" arm.

If the signature is coherent, then most of the genes from each arm should correlate with the corresponding arm average and anti-correlate with the average of all the genes in the opposite arm. A Fisher exact test is calculated for correlation within and between arms of the gene signature to assess the significance of the signature's coherence in a new dataset.

Signatures are refined by filtering out the genes that do not show the correct correlation-anti-correlation behavior. This filtering process enables the identification of a subset of signature genes that retains the core information regarding growth factor pathway signaling activity and elimination of genes that might report on other activities when analyzing a new dataset.

Signature scores were calculated as: mean expression of "up" genes (see Table 5a)−mean expression of "down" genes (see Table 5b).

Initial signature coherence was performed on three platforms: cell lines (CMTI portion of the Cell Line Atlas (breast, colon, lung)), fresh tumors (Tumor Atlas for breast, colon, lung), and formalin-fixed paraffin embedded (FFPE) samples (the Mayo FFPE datasets for lung, ovarian, and colon). Validation was performed on Netherlands Cancer Institute (NKI) colon and breast datasets.

Figure 14A:
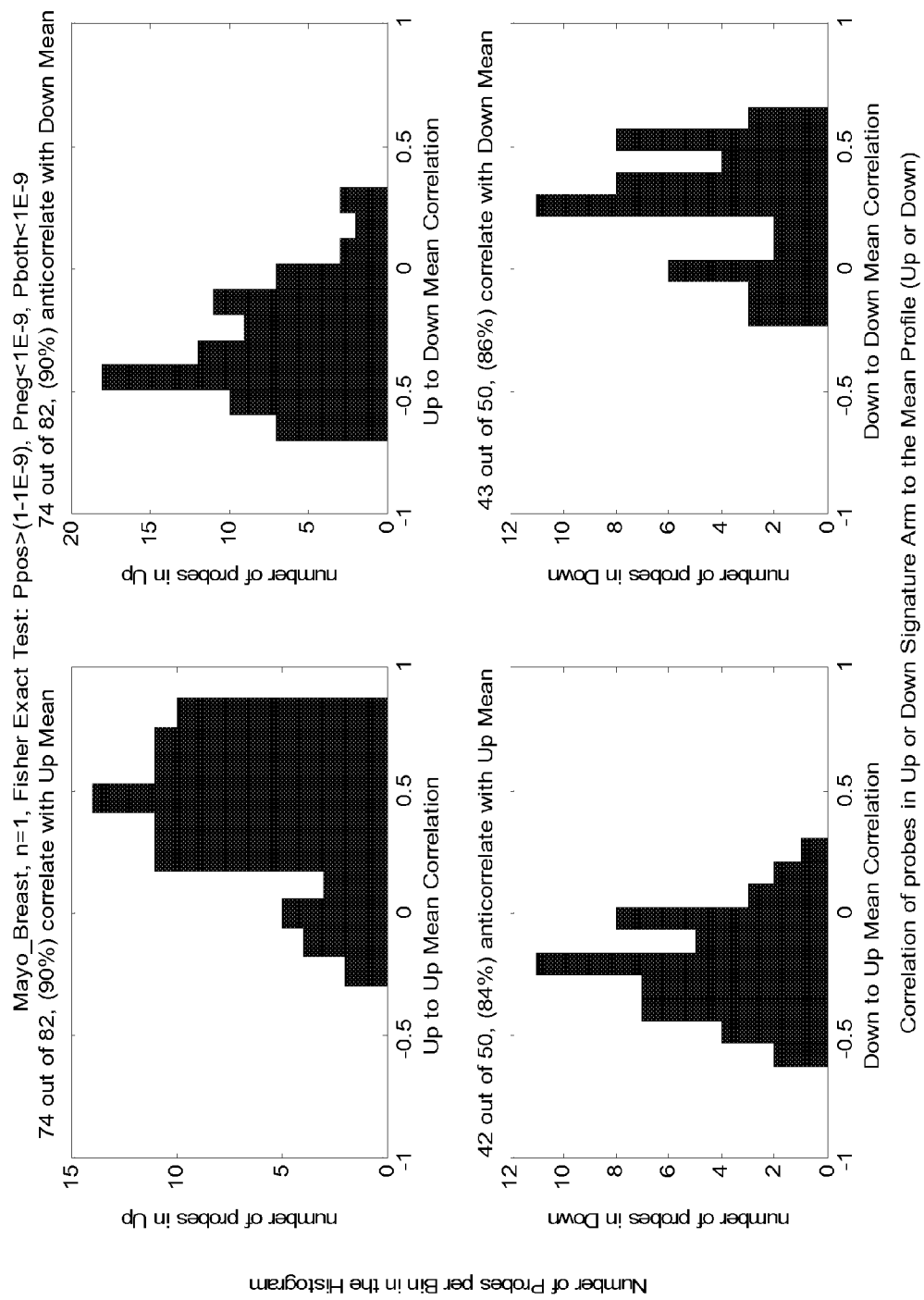
Figure 14B:
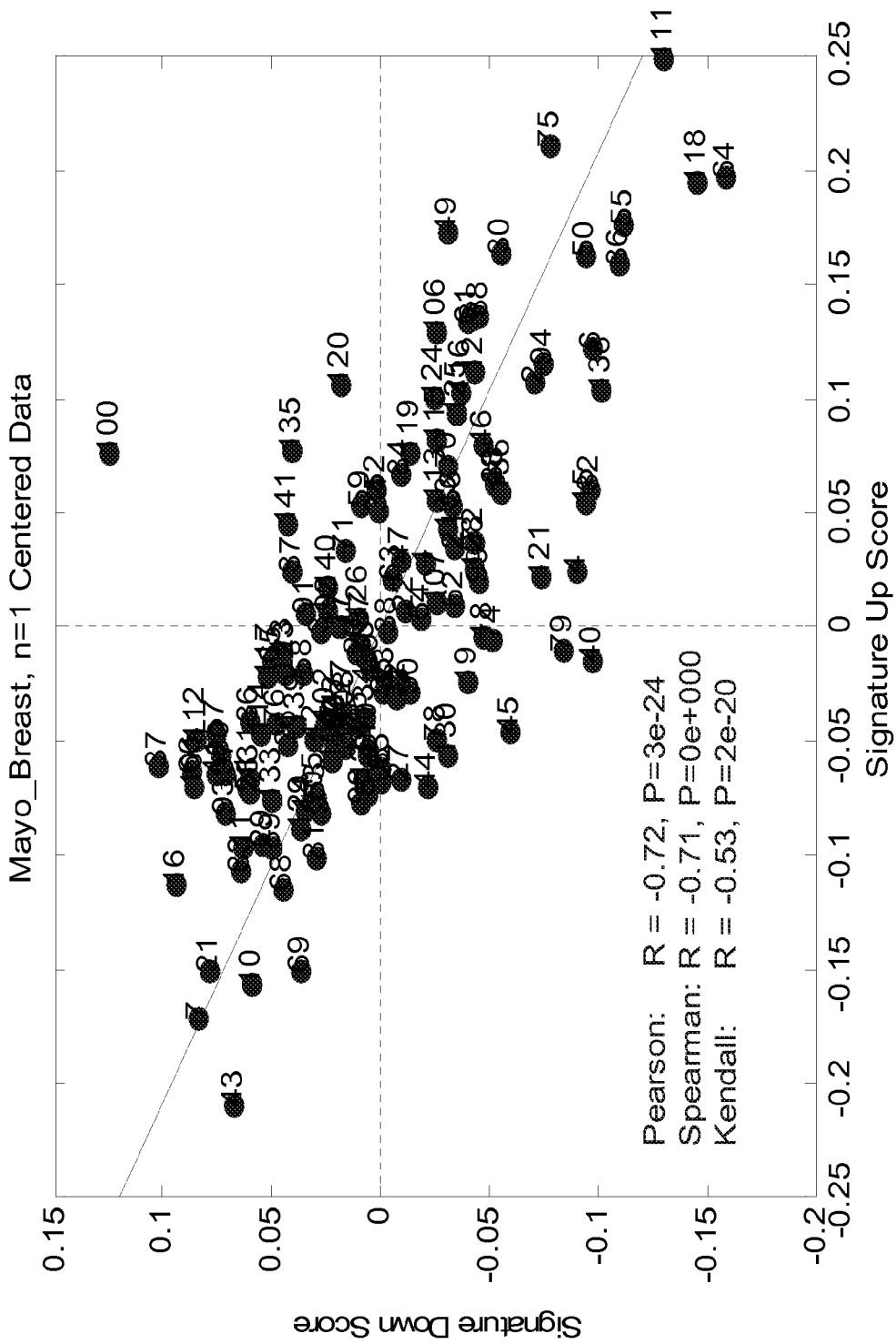

The coherence analysis in FFPE breast tumor samples shows that the "up" and "down" arms of the 101 gene signature is highly coherent, with a p-value of less than $10^{-9}$ by a Fisher exact test (see FIG. 14a). A heatmap of all 101 genes of the growth factor pathway signature shows that the "up" and "down" arms of the signature cluster apart in this dataset (not shown). A scatter plot of the "up" and down" arms of the 101 gene signature shows that each branch significantly anti-correlate from each other (FIG. 14b). The p-value of the anti-correlation between the "up" and "down" arms is significant based on the Pearson, Spearman, or Kendall correlation tests (R=−0.72, p=3e-24; R=−0.71, p=0e+000; R=−0.53, p=2 e-20, respectively).

Next, the same analysis was repeated for the up and down arms on the other training datasets as previously described. The results of the Fisher test, as previously illustrated in FIG. 14a, performed on all the datasets are summarized in Table 7. This table shows consistently highly significant behavior for the 101 gene signature for growth factor pathway signaling across nearly all the datasets.

arm or do not anti-correlate with genes in the opposite arm. The improvements after filtering can be seen in the heatmaps and scatterplots before and after filtering (FIGS. 14a, and b, compared to FIGS. 15a, b, and c).

The refining process retained a high percentage of the genes in both arms of the growth factor pathway gene signature, as shown in Table 8. More than 60% of the original 101 gene signature shows the correct co-regulation pattern in FFPE samples in all three tumor types that were tested. Starting with the original 101 biomarker set, 81, 73, and 63 genes from the original geneset passé dhte coherence test in the Mayo FFPE breast, lung, and ovarian datasets, respectively. A core FFPE-derived signature (40 genes from the "up" arm and 17 genes from the "down" arm) that was coherent across all the datasets was obtained from the Mayo FFPE samples. The core FFPE signature is presented in Table 8b. In the fresh tumor samples from the Tumor Atlas, the results are very similar for breast, colon, and lung datasets (>70% of the original 101 gene signature shows the correct co-regulation pattern), and slightly less statistically significant in gastric and kidney tumor sets (>50%). At least 70% or more of the original 101 gene signature shows the correct co-regulation pattern in breast, colon, and lung cell lines. A global core biomarker gene set that passed the coherence filter, common

TABLE 7

Significance of the growth factor pathway signature coherence for different tumor types and platforms. First row indicates the platform on which the test was performed. Second row indicates the tumor type. Marginally significant tests are shaded in gray.

| Mayo | Mayo | Mayo | CMTI | CMTI | CMTI | CMTI | Tumor Atlas | Tumor Atlas | Tumor Atlas | Tumor Atlas | Tumor Atlas |
|------|------|------|------|------|------|------|-------------|-------------|-------------|-------------|-------------|
| Breast | Lung | Ovary | Breast | Colon | Lung | Lymphoma | Breast | Lung | Colon | Kidney | Gastric |
| <1e-12 | 9.e-07 | 2.e-06 | <1e-12 | <1e-12 | <1e-12 | 1.e-08 | <1e-12 | <1e-12 | <1e-12 | 5.e-06 | 1.e-02 |

The 101 gene signature can be further refined by winnowing the genes that do not correlate with the other genes in its arm or do not anti-correlate with genes in the opposite among the different tumor types and across the various platforms tested, is presented in Table 8c.

TABLE 8a

The percentage of genes (as a fraction of the 101 genes in the original growth factor pathway signature list) that passed the coherence filter in different tumor types (such as breast, lung, ovary, colon, kidney, lymphoma, and gastric) and platforms (cell lines, fresh tumors, or FFPE, represented by CMTI portion of the Cell Lines Atlas, the Tumor Atlas, and the Mayo FFPE datasets, respectively).

| Mayo Breast | Mayo Lung | Mayo Ovary | CMTI Breast | CMTI Colon | CMTI Lung | CMTI Lymphoma | Tumor Atlas Breast | Tumor Atlas Lung | Tumor Atlas Colon | Tumor Atlas Kidney | Tumor Atlas Gastric |
|---|---|---|---|---|---|---|---|---|---|---|---|
| 81% | 73% | 63% | 76% | 73% | 70% | 50% | 72% | 70% | 73% | 53% | 59% |

TABLE 8b

Core FFPE biomarker set derived from the Mayo FFPE breast, lung, and ovarian datasets after refinement.

| Gene Symbol | Arm | SEQ ID NO: |
|---|---|---|
| C10orf7 | up | SEQ ID NO: 13 |
| CCNA2 | up | SEQ ID NO: 74 |
| CDC45L | up | SEQ ID NO: 82 |
| CDCA4 | up | SEQ ID NO: 122 |
| CSTF2 | up | SEQ ID NO: 5 |
| CTPS | up | SEQ ID NO: 116 |
| DKC1 | up | SEQ ID NO: 141 |
| DPH2 | up | SEQ ID NO: 32 |
| DTYMK | up | SEQ ID NO: 139 |
| E2F7 | up | SEQ ID NO: 112 |
| EEF1E1 | up | SEQ ID NO: 7 |
| EIF5A | up | SEQ ID NO: 18 |
| FABP5 | up | SEQ ID NO: 149 |
| GART | up | SEQ ID NO: 76 |
| HNRPAB | up | SEQ ID NO: 130 |
| IFRD2 | up | SEQ ID NO: 90 |
| LDHA | up | SEQ ID NO: 88 |
| LETM1 | up | SEQ ID NO: 126 |
| MCM10 | up | SEQ ID NO: 124 |
| MCM7 | up | SEQ ID NO: 120 |
| MRPS23 | up | SEQ ID NO: 36 |
| NIP7 | up | SEQ ID NO: 44 |
| NOLC1 | up | SEQ ID NO: 118 |
| NUP155 | up | SEQ ID NO: 131 |
| ODC1 | up | SEQ ID NO: 16 |
| PFDN2 | up | SEQ ID NO: 24 |
| PSMA3 | up | SEQ ID NO: 11 |
| PSMA4 | up | SEQ ID NO: 9 |
| PSMB1 | up | SEQ ID NO: 14 |
| PSMC4 | up | SEQ ID NO: 38 |
| RAD54L | up | SEQ ID NO: 84 |
| RANBP1 | up | SEQ ID NO: 80 |
| SHCBP1 | up | SEQ ID NO: 137 |
| TOMM40 | up | SEQ ID NO: 152 |
| TRIP13 | up | SEQ ID NO: 128 |
| UCHL3 | up | SEQ ID NO: 20 |
| UCK2 | up | SEQ ID NO: 114 |
| WDR62 | up | SEQ ID NO: 135 |
| ZWILCH | up | SEQ ID NO: 145 |
| ZWINT | up | SEQ ID NO: 143 |
| ACSS1 | down | SEQ ID NO: 194 |
| APLP2 | down | SEQ ID NO: 53 |
| ARNT2 | down | SEQ ID NO: 192 |
| CCT6B | down | SEQ ID NO: 174 |
| CHES1 | down | SEQ ID NO: 49 |
| CTDSP2 | down | SEQ ID NO: 47 |
| FANK1 | down | SEQ ID NO: 172 |
| HBP1 | down | SEQ ID NO: 104 |
| HHAT | down | SEQ ID NO: 188 |
| MLLT7 | down | SEQ ID NO: 106 |
| MST1 | down | SEQ ID NO: 63 |
| MXD4 | down | SEQ ID NO: 102 |
| PINK1 | down | SEQ ID NO: 59 |
| SEPP1 | down | SEQ ID NO: 55 |
| SSBP2 | down | SEQ ID NO: 108 |
| TMC4 | down | SEQ ID NO: 186 |
| ZFYVE1 | down | SEQ ID NO: 71 |

TABLE 8c

Global core biomarker set in common among the different tumor types (such as breast, lung, ovary, colon, kidney, lymphoma, and gatric) and platforms (cell lines, fresh tumors, or FFPE, represented by CMTI portion of the Cell Line Atlas, the Tumor Atlas, and the Mayo FFPE datasets, respectively) after refinement.

| Gene Symbol | Arm | SEQ ID NO: |
|---|---|---|
| APLP2 | Down | SEQ ID NO: 53 |
| CCT6B | Down | SEQ ID NO: 174 |
| CHES1 | Down | SEQ ID NO: 49 |
| CTDSP2 | Down | SEQ ID NO: 47 |
| FANK1 | Down | SEQ ID NO: 172 |
| HBP1 | Down | SEQ ID NO: 104 |
| MLLT7 | Down | SEQ ID NO: 106 |
| MST1 | Down | SEQ ID NO: 63 |
| MXD4 | Down | SEQ ID NO: 102 |
| TMC4 | Down | SEQ ID NO: 186 |
| ZFYVE1 | Down | SEQ ID NO: 71 |
| C10orf7 | Up | SEQ ID NO: 13 |
| CCNA2 | Up | SEQ ID NO: 74 |
| CDC45L | Up | SEQ ID NO: 82 |
| CDCA4 | Up | SEQ ID NO: 122 |
| CSTF2 | Up | SEQ ID NO: 5 |
| CTPS | Up | SEQ ID NO: 116 |
| DKC1 | Up | SEQ ID NO: 141 |
| DTYMK | Up | SEQ ID NO: 139 |
| E2F7 | Up | SEQ ID NO: 112 |
| EEF1E1 | Up | SEQ ID NO: 7 |
| EIF5A | Up | SEQ ID NO: 18 |
| FABP5 | Up | SEQ ID NO: 149 |
| GART | Up | SEQ ID NO: 76 |
| IFRD2 | Up | SEQ ID NO: 90 |
| LETM1 | Up | SEQ ID NO: 126 |
| MCM10 | Up | SEQ ID NO: 124 |
| MCM7 | Up | SEQ ID NO: 120 |
| NOLC1 | Up | SEQ ID NO: 118 |
| NUP155 | Up | SEQ ID NO: 131 |
| ODC1 | Up | SEQ ID NO: 16 |
| PFDN2 | Up | SEQ ID NO: 24 |
| PSMB1 | Up | SEQ ID NO: 14 |
| PSMC4 | Up | SEQ ID NO: 38 |
| RAD54L | Up | SEQ ID NO: 84 |
| RANBP1 | Up | SEQ ID NO: 80 |
| SHCBP1 | Up | SEQ ID NO: 137 |
| TOMM40 | Up | SEQ ID NO: 152 |
| TRIP13 | Up | SEQ ID NO: 128 |
| UCK2 | Up | SEQ ID NO: 114 |
| ZWINT | Up | SEQ ID NO: 143 |

In addition to assessing the amplitude of the signature score, the significance of the difference between the "up" and "down" arms of the signatures was assessed. The p-value for each sample in each platform tested was calculated using the Kolmogorov-Smirnov test. As shown in FIG. 16, across multiple sample types and platforms, the majority of the samples show significance at $\alpha=0.05$ level, indicating that for a majority of the samples, the signature score for each sample is significantly different from the standard/control sample. Validation that the Kolmogorov-Smirnov test was sufficiently conservative to test the difference between the "up" and "down" arms was also performed. The T-test and Wilcoxon rank sum tests were also performed on the signature score in the Mayo FFPE datasets (FIG. 17). The p-values obtained in each of the three tests match very well for most of the samples, suggesting that we are capturing a true difference between the "up" and "down" branches of the signature.

Example 10

Conversion of Microarray Based Gene Expression Signature into qPCR Assay

As an alternative to microarrays, it may be desirable to perform gene expression analysis using quantitative PCR. Quantitative PCR has a short turn-around time, low sample input requirements, and robust measurement in FFPE tissues.

However, conversion of gene expression signatures for use in a quantitative PCR platform requires signature down-selection and alternative methods for signature scoring. Furthermore, data from quantitative PCR cannot be directly compared to existing datasets of tumor gene expression profiles.

In order to design a strategy for signature translation to qPCR, we first identified the desirable properties of the final product: 1) the assay should work in FFPE samples; 2) the assay should be down-selected from hundreds of genes to tens of genes to enable ease of measurement using qPCR; 3) the down-selected genes should provide signal in multiple tumor types, as they assays may be applied to oncology clinical trials involving multiple tumor types; 4) the down-selected genes should carry as much signal as possible compared to the overall signature that is measured using microarrays; 5) a scoring algorithm should be created that provides results similar to those obtained using microarrays; 6) the assay should be able to provide a score from a single patient sample. In order to meet these desired expectations, we designed the strategy as described in FIG. 18.

Phase 1: Prioritization of Genes

The microarray based signature (101 genes) contains more genes than could be reasonably or cost-effectively be converted into a qPCR assay. We first needed a strategy for down-selection of signature genes that would subsequently be carried into qPCR assay development. The power of gene expression signatures lies in the sensitivity and confidence provided by measuring large gene sets. When down-selecting, we should ensure that minimal power is lost. Because clinical implementation requires that the assays be qualified on FFPE tissue from multiple tumor types, the overriding priority for gene down-selection was the retention of coherence when genes are measured across FFPE tumors. All the genes in the microarray based signature are highly correlated when studied in pre-clinical samples (cell lines, xenographs) and fresh-frozen tumor samples from multiple tumor datasets. However, for a gene to carry signal, it should retain this pattern of co-regulation with other signature genes when assayed in FFPE material.

To prioritize the signature genes, we used the coherence analysis approach previously described in Example 9. The growth factor signaling pathway signature was split into two opposing "arms"—the "up" arm, which are the genes that are up-regulated, and the "down" arm, which are the genes that are down-regulated, as signaling through the pathway increases. The purpose of the coherence analysis is to show the statistical significance of the difference between the "up" and "down" arms of the signature in a new dataset. Two correlation coefficients were calculated for all of the genes in both the "up" and "down" arms. First, the correlation between each gene in the "up" arm and the average of all genes in the "up" arm is calculated. Second, the anti-correlation between each gene in the "up" arm and the average of all the genes in the "down" arm is calculated. This is repeated for the genes in the "down" arm. If the signature is coherent, most of the genes from the "up" arm should correlate with the average of all "up" genes and anti-correlate with the average of all genes in the "down" arm. A Fisher exact test is calculated for correlation within and between arms of the signature to assess the significance of signature coherence in a new dataset. Signatures are refined by filtering out the genes that do not show the correct correlation-anti-correlation behavior. This filtering process enables the identification of the subset of signature genes that retains the core information regarding signaling activity and elimination of genes that might report on other activities when analyzing a new dataset. By performing this procedure, we prioritized 40 genes for the growth factor signaling pathway signature.

Phase 2: qPCR Assay Development for Each Down-Selected Signature Gene

To obtain an analytically validated qPCR assay for each of the prioritized genes, multiple potential assays were designed and tested, allowing for multiple designs per gene as well as splice variants in some genes. Plasmid DNA or synthetic DNA standards for each gene target and corresponding IVT-generated RNA standards were generated. These standards were titrated over 3 logs to assess linearity in DNA and 5 logs in RNA to assess linearity, sensitivity, and specificity (data not shown). Assays were grouped into one of three "sets" based on early performance data from FFPE sample isolations and analytical properties. For each gene, an assay was selected using criteria such as distance from the Agilent microarray probe, PCR efficiency (NT RNA standards), and average Ct value on 2 ng of FFPE RNA input. FIG. 19 shows a histogram of the PCR efficiency obtained for each assay developed. The vast majority of assays showed PCR efficiencies very close to 1.0, indicating that correction for PCR efficiency was not necessary when performing calculations. As a result, one qPCR assay for each down-selected gene was moved forward to Phase 3.

Phase 3: Further Down-Selection of Signature to a Core Gene List

The aim was to reduce to the final size of the growth factor signaling pathway signature to approximately 20 biomarker genes and 3-5 normalizer genes. Preferably, the qPCR assays should be qualified on FFPE tissue from multiple tumor types for clinical implementation of the signature. Therefore, further down-selection was based on the expression characteristics of each qPCR assay across a panel of 30 FFPE tumor blocks for breast, colon, lung, and gastic cancers. The FFPE tumor blocks were >50% tumor and less than 3 years old.

Each analytically validated qPCR assay was then run in each FFPE tumor sample. FIG. 20 shows the representative data for 10 randomly selected assays across the 120 FFPE tumor samples. Using the following strategy, the signature was down-selected to 20 biomarker genes. First, keep approximately 10 "up" arm genes and 10 "down" arm genes in the final signature. This "balanced" design is helpful for coherence analysis to show the statistical significance of the difference between the "up" and "down" arms of the signature in a new dataset. This "balanced" design may also have advantages in quantifying the signature (see Phase 4). Second, a gene in the "up" arm must correlate with the average expression level of all "up" genes and anti-correlate with the average expression level of all genes in the "down" arm, and vice-versa for genes in the "down" arm. Third, genes that show coherence across all 4 tumor types tested are prioritized. Last, to enable a smaller input RNA amount, prioritize genes that have an average Ct value<30 across n=120 tumor samples. Using these criteria, the gene signature for the growth factor signaling pathway was selected (10 "up" arm genes and 10 "down" arm genes) (see Table 9). The qPCR primer and probe sequences used for the down-selected qPCR growth factor signaling signature are also presented in Tables 9 and 10, respectively. FIG. 21 shows a correlation matrix for the 20 gene down-selected signature for growth factor signaling pathway across FFPE tumors. This correlation matrix shows the correlation within the "up" arm, within the "down" arm, and the anti-correlation between the "up" and "down" arms across 120 FFPE tumor samples.

TABLE 9

Down-selected qPCR signature and qPCR primers. A) "Up" Arm

| Gene Symbol | Arm | SEQ ID NO: | qPCR Forward Primer | qPCR Reverse Primer |
|---|---|---|---|---|
| RANBP1 | Up | SEQ ID NO: 80 | GATCTGTGCCAACCACTACAT | GGCTTGGGGCACTCGT |
| TRIP13 | Up | SEQ ID NO: 128 | GCCGGGTCCTGAGAAA | GACAGGGCCTGGAGGAA |
| TOMM40 | Up | SEQ ID NO: 152 | CCGGTCTCAGGTCCAA | GTGACGGCTGCTGTGAA |
| CTPS | Up | SEQ ID NO: 116 | GCTGGGCAAGAGGAGAA | CGGTGCCTCTCTTCCAA |
| DTYMK | Up | SEQ ID NO: 139 | TCCACCAGCTCATGAAAGAC | CCCAGCGGCTTCTCTGT |
| MCM7 | Up | SEQ ID NO: 120 | AGATGAGGCGAGAGGCTT | CTCCACCACATCCACCATT |
| HNRPAB | Up | SEQ ID NO: 130 | GGCCATGGCTATGAAGAA | GGCCTCAATCTCCCCAAA |
| MYC | Up | SEQ ID NO: 78 | AGCCCACTGGTCCTCAA | CAGGACTCTGACACTGTCCAA |
| EIF5A | Up | SEQ ID NO: 18 | GAGACCTTGGCAAGGAGATT | CATCCTGGGAGCCAGTTATT |
| DPH2 | Up | SEQ ID NO: 32 | GAGCGAGTCGCTGGATT | AGCCACAGCCACAGCAT |
| ODC1 | Up | SEQ ID NO: 16 | GGTGCCACGCTCAGAA | CTACATGGAAGCTGACACCAA |

TABLE 9B

"Down" arm of down-selected qPCR signature

| Gene Symbol | Arm | SEQ ID NO: | qPCR Forward Primer | qPCR Reverse Primer |
|---|---|---|---|---|
| MST1 | Down | SEQ ID NO: 63 | ACTGCTGGGTCCTGGAA | CCAGTCTCATGACCTTGTGAA |
| CTDSP2 | Down | SEQ ID NO: 47 | TTTGCTTATCATGTTCCATTTC | CCCATAGCCCAGTCACAGT |
| CCT6B | Down | SEQ ID NO: 174 | GCGAGCTGGGATGTCTT | ATGGCTCAGGCTACACAATAGTA |
| SEPP1 | Down | SEQ ID NO: 55 | GCTCTCTCACGACTCTCAAA | GTGATGATGCTCATGATGGTAA |
| HHAT | Down | SEQ ID NO: 188 | CCGGGGTGCTCAGAA | CTCTGGCTGCCCACAAA |
| SSBP2 | Down | SEQ ID NO: 108 | CCCAGTCCAGTGCTAGGAA | CAGGGTACCGAGGTGACATAA |
| FANK1 | Down | SEQ ID NO: 172 | GAAGTGGCAAGGACAGTCTAA | GGTCTCTAGCCTGCCAAGAA |
| MXD4 | Down | SEQ ID NO: 102 | ACGGACGACTCAGAGCAA | GTCACTGCTGCTGCCAA |
| ZFYVE1 | Down | SEQ ID NO: 71 | GTATTTCACCTGCTCCTCCTT | TCATGAGGCACTCCTTCCTT |

TABLE 9C

Normalizer genes of down-selected qPCR signature

| | | |
|---|---|---|
| NUP214 (NM_005085) | NormalizerSEQ ID NO: 198 | CACTGGATCCCAAGAGTGAA TGATCCCACTCCAAGTCTAGAA |
| SAFB (NM_002967) | NormalizerSEQ ID NO: 199 | GGACCGAACGGACTGTAGTAA CGATCCTGGCTTTTGGAA |
| PRPF8 (NM_006445) | NormalizerSEQ ID NO: 200 | CGCTCACCACCAAGGAA TCCCGACACAGGTGGAA |

TABLE 10 qPCR probe sequences for down-selected geneset

| Gene Symbol | Arm | SEQ ID NO:Probe Sequence |
|---|---|---|
| RANBP1 | Up | SEQ ID NO: 80 TTTTCGGTTTGTTTTTATTCTTTCATTTTT ACAAGGGACGTTATATAAAGAACTGAACTC |
| TRIP13 | Up | SEQ ID NO: 128 GGTCAGTTACTGGTCTCTTTCTCCGAATGT TATGTTTTGCTTTTATCTCACAGTAAAATA |
| TOMM40 | Up | SEQ ID NO: 152 CATCTCCTCGGTATAAATCATGTTTATAAG TTATGGAAGAACCGGGACATTTTACAGAAA |
| CTPS | Up | SEQ ID NO: 116 CACTATATTCTGGCCAGACTCGATGTGTAC TCTAACTTAAGAAATAAATCAGTAAGGCAG |
| DTYMK | Up | SEQ ID NO: 139 CTTACTGAAGTTCAGTGATAACTCTGAGCA GTTTCATTGTGATCACTGTAAATGGTAATC |
| MCM7 | Up | SEQ ID NO: 120 GGGGAAGGAGGAGCCCCTCTTTCTCCCATG CTGCACTTACTCCTTTTGCTAATAAAAGTG |
| HNRPAB | Up | SEQ ID NO: 130 TTGGTACCCCTTTTGGGAATCTAATGTATT GTAAGGTATTTTACACGTGTCCTGATTTTG |
| MYC | Up | SEQ ID NO: 78 GTTACACAGAATTTCAATCCTAGTATATAG TACCTAGTATTATAGGTACTATAAACCCTA |
| EIF5A | Up | SEQ ID NO: 18 AGGTCCATCTGGTTGGTATTGACATCTTTA CTGGGAAGAAATATGAAGATATCTGCCCGT |
| DPH2 | Up | SEQ ID NO: 32 TATACTGACTCTTATTTCTCAGGGAGATCA CAGCAACCTAAATAAACCAGATACCTTTTC |
| ODC1 | Up | SEQ ID NO: 16 AGTATTAATGTGTAGATAGCACTCTGGTAG CTGTTAACTGCAAGTTTAGCTTGAATTAAG |
| MST1 | Down | SEQ ID NO: 63 TCACAAGGTCATGAGACTGGGTTAGGCCCA GCCTTGATGCCATATGCCTTGGGGAGGACA |
| CTDSP2 | Down | SEQ ID NO: 47 TGCTTACAGATTCATGGTTTGATAAATTTG TTGTATTCCAAAACTTGAAATGCAGGACGC |
| CCT6B | Down | SEQ ID NO: 174 ATCAACCCTTCTAGAAGATGAAATTTAGTA CACTTTACATCTGACTACTATTGTGTAGCC |
| SEPP1 | Down | SEQ ID NO: 55 GTAAGTATTTCCATAGTCAATGATGGTTTA ATAGGTAAACCAAACCCTATAAACCTGACC |
| HHAT | Down | SEQ ID NO: 188 TTTAAACTATTATATGATTCATAATGGTTC TCAGGAATTAATAAATGATTACTGTGTTTA |
| SSBP2 | Down | SEQ ID NO: 108 AGGTGAACTCAGATGTTATGGTTTTGTATA TGTCTGCAATCATGGATAGGAATAAAATCG |
| FANK1 | Down | SEQ ID NO: 172 GGGGGCTGTACATTTATTTATTTAGTTGAA GATTCACTGATCCCACTTTGAAATACATCT |
| MXD4 | Down | SEQ ID NO: 102 CCGTGTGGGCCGTGCTGTGTCCTTATGTCA TTGTAATATAAATACAGATTTTTATATCTC |
| ZFYVE1 | Down | SEQ ID NO: 71 ACTGGGACCCTACTCTAGAACTGTGTACCA TCCAATTCGCCATCATAAAGGAATCTTCCT |

In addition to the biomarker genes, normalizer genes may also be selected for future signature quantification. Normalizer genes should be stably expressed across the samples of interest, should have a similar expression level to the biomarker genes, and should be robustly detected. In order to identify potential normalizer genes, multiple candidates were measured in the 120 tumor samples. A group of normalizer genes were nominated based upon previous experience and lack of regulation across the FFPE profiles. FIG. 22 shows the expression variation of 5 candidate normalizer genes that were tested. The average Ct value (averaged across technical triplicates) was plotted across all 120 samples. As shown in FIG. 22, two of the candidate normalizers (RPLP1 and RPS29) had high coefficients of variation and had quite low Ct values. Alternatively, the remaining three candidate normalizer genes, NUP214, SAFB, and PRPF8, had low coefficients of variation (maximum of 3.22%) and had Ct values in the range of the biomarker genes. As such, these three genes were chosen as our final normalizer genes.

qPCR Conditions:

All volumes and plate layouts are based on setting up with the assistance of a liquid-handling robot in a 96-well pipetting format. The PCR reaction is assembled by adding 50 of RNA sample into 10 μl of the combined primers and PCR master mixture into a 384-well plate.

PCR Reagents

1. CRA Biomarker 7900 Partial Master Mix (CRA Biomarker 7900 PMMx)

Determine the density of each component and assemble CRA Biomarker 7900 PMMx by weight based on the proportion of 5 components listed below:

| Volume (ml) | Components |
|---|---|
| 27 | DNase and RNase-free H2O |
| 900 | 250 mM Bicine, 575 mM KOAc, 40% glycerol, pH 8.0 (Fluka) |
| 90 | dNTP (10 mM each ATP, GTP, CTP, and 20 mM UTP) |
| 45 | 20X SYBR Green I in 100% DMSO |
| 24 | 79 μM ROX (5-carboxy-X-rhodamine, Invitrogen) in 5% Tween-20 |

2. 75 mM Mn(OAc)$_2$, pH 6.5 (store at 4° C.)
3. 15 µM enhancer (Celera, store at −20° C.)
4. 2 units/µl Uracil N-glycosylase (UNG) (Applied Biosystems, store at −20° C.)
5. 2.5 units/µl rTth DNA polymerase (Applied Biosystems, store at −20° C.)
6. Primers (store at −20° C.) −100 µM of each primers
7. TE buffer (10 mM Tris-HCl, 0.1 mM EDTA, pH 8.0)
8. RNA Diluent (0.06 EDTA, pH 8.0, 0.03% Na Azide, 24 µg/ml poly rA (Amersham)) (store at 4° C.)

RNA Samples

RNA samples from clinical specimens was stored at −70° C. FFPE samples were diluted to 100 pg/µl. Positive control Stratagene 2×200 µg Universal Human Reference RNA was diluted to 3 ng/µl with RNA diluent. Diluted RNA samples were stored at −20° C. for short term storage and −70° C. for long term storage.

Preparation of Primer Sets

Individual primers were stored at 100 µM stock. Primers were thawed at room temperature and diluted from 100 µM stock to 20 µM working concentration. Forward and reverse primers were paired for each assay before assembly of PCR reactions.

150 µl RNase free TE buffer was aliquoted into each 1.5 ml tube. 9.0 µl of TE was removed from each tube. 4.5 µl of each 20 µM forward and reverse primer was transferred to its respective reaction tube. Each tube was mixed well and spun down.

Preparation of Complete Master Mix (Complete MMx)

The CRA Biomarker 7900 PMMx was thawed completely at room temperature in the dark, and mixed well. 15 µM enhancer (Celera), 2 units/µl UNG (Uracil N-glycosylase, Applied Biosystems), and 2.5 units/µl rTth DNA polymerase (Applied Biosystems) were thawed out a room temperature and mixed well. 2896 µl of CRA Biomarker 7900 PMMx was pipetted into a 5-ml tube. A complete master mix for 800 reactions (including waste and dead volume required by liquid handling robot) was prepared. Enhancer, Mn(OAc)$_2$, UNG, and rTth DNA polymerase was added following the table below. Complete master mix was gently mixed well, spun, and covered with foil.

| Volume/rxn (µl) | Component | Volume (µl) for 800 rxn |
|---|---|---|
| 3.62 | CRA Biomarker 7900 Partial Master Mix | 2896 |
| 0.03 | 15 µM enhancer | 24 |
| 0.6 | 75 mM Mn(OAc)2, pH 6.5 | 480 |
| 0.15 | 2 units/µl UNG | 120 |
| 0.600 | 2.5 units/µl rTth DNA polymerase | 480 |

Preparation of Primer Set and Master Mix (PS+MMx) Source Plates

150 µl of Complete MMx was added to each of the primer sets. The components were mixed gently and spun. 30 µl of each PS+MMx was aliquoted into a 96-well plate and covered with non-optical seal and spun down for 1 minute.

Preparation of RNA Source Plates (for RNA from FFPE Samples)

Clinical RNA samples were diluted to 100 pg/µl. 30 µl of each clinical RNA sample (100 pg/µl), control, and TE were aliquoted into each of 12 wells in a 96-well plate. Plate was covered with non-optical seal and spun down for 1 minute.

Preparation of 384-Well Amplification Plate

A liquid handling robotic station was used to dispense PS+MMx and RNA samples from the 96-well plates to one 384-well plate. A pre-PCR robot (had not been used for DNA/RNA) was used to dispense 10 µl from 96-well "PS+MMx Source Plate" to a 384-well amplification plate. Another robot was used to dispense 5 µl from the 96-well "RNA Source Plate" to the 384-well amplification plate. The plate was covered with optical seal and spun for 1 minute.

Profiling Run

Samples were run on the AB7900HT using SDS software with the following cycle conditions:

| | |
|---|---|
| Stage 1: | 50° C. 2 min |
| Stage 2: | 95° C. 1 min |
| Stage 3: | 60° C. 30 min |
| Stage 4: | 95° C. 15 sec |
| | 60° C. 30 sec - data collection for 42 cycles |
| Stage 5: | 95° C. 1 min |
| Stage 6: | 60° C. 1 min |
| Stage 7: | 95° C. 1 min - data collection (2% ramp rate) |

Phase 4: Adaptation of a Scoring Algorithm to Obtain a Signature Score Using the qPCR Platform Another issue encountered when translating signatures from the microarray to qPCR platforms is that the data output is different. Microarray data are expressed in terms of intensity values or log ratios, whereas qPCR data are expressed in terms of threshold cycle (Ct). Therefore, the scoring algorithm created for the microarray platform needed to be adapted for use on the qPCR platform. Additionally, while signature scores of a new sample derived from a microarray platform can be compared to existing databases of tumor sample expression profiling data, in order to normalize each sample to a reference, such a dataset does not exist for qPCR. Therefore, a scoring algorithm that can be performed on a single qPCR sample without the need for comparing to a reference set was created.

To create a signature score that reflects pathway activity on a qPCR platform that does not require comparison to a reference database, a ranking scheme comparing the relative expression of the "up" and "down" arms was used. The scheme can be summarized as follows: 1) transform Ct values to $\log 10(2^{\wedge}\text{-Ct})$ (this transformation converts Ct values into an abundance measurement); 2) rank each gene based on the value of the $\log 10(2^{\wedge}\text{-Ct})$ transformation; 3) create a mean rank score (MRS) for each arm of the signature; 4) calculate signature score based on average rank of the "up" arm minus the average rank of the "down" arm.

All the signature genes for a given sample were run on the same PCR plate, and that ranking was performed using calculated relative abundances for the signature genes using only values within the given sample. The threshold value for the signature score was set at zero in this particular example. A positive signature score is indicative of high or deregulated growth factor pathway signaling activity. A negative signature score is indicative of low or regulated growth factor pathway signaling activity. The significance of this signature score can also be assessed by comparing the expression values or ranks of the signature genes in the "up" and "down" arms. As previously described in Example 9, statistical tests, such as Komogorov-Smirnov, t-test, or Wilcoxan test, can be used to assess the significance of the difference of gene expression in the "up" and "down" arms in individual samples. If the signature score is positive and t-test p-value<0.05, then the signature score would be considered to be significantly high. A signature score that is positive with a p-value>0.05 would be considered to be indeterminate. It should be noted that this method of calculating signature score on the qPCR platform does not require normalization to housekeeping genes. This is because the signature is internally balanced due to the "up" and "down" arms, so the expression of each signature gene does not need to be normalized to the normalizer genes. However, the same calculation described above can be performed by first subtracting the mean Ct value of the normalizer genes from the Ct value of each signature gene.

Phase 5: Assessment of Signature on Blinded Test Samples.

Once the original 101 gene signature had been down-selected to 20 and a scoring algorithm had been created for the qPCR platform, a test was developed to determine the "success" of the qPCR signature translation. Approximately 40 FFPE samples from the Mayo clinic had been previously scored for growth factor pathway signaling using microarray profiling data. Lung, ovarian, breast cancer samples that represented the extremes of signature distribution were selected. Based on microarray profiling data, 20 samples with quite low signature scores and 20 samples with quite high signature scores were tested by qPCR in a blinded fashion. Signature scores obtained from qPCR data were compared to the scores generated from microarray data. FIG. 23 shows comparison of the qPCR signature scores (bar graph on the left) to the signatures scores generated by microarray (bar graph on the right) for the ovarian FFPE samples. The sign of the signature scores generated by qPCR and microarray were consistent for each ovarian sample.

Example 11

Identification of an Alternative Growth Factor Signaling Pathway Signature

Materials and Methods
Cell Culture and Treatment of Cell Lines with Growth Factors MCF-7 and HT-29 cell lines were seeded in 6-well plates to achieve 40-50% confluence at the time of growth factor addition. Cells were serum starved for 24 hours in 0.2% charcoal stripped serum, and growth factors were added at 100 ng/ml (EGF, IGF, insulin, b-FGF) or 30 ng/ml (heregulin). Concentrations of growth factors were chosen to give maximal activation of growth factor receptors as judged by receptor autophosphorylation. Activation of growth factor receptor pathways after growth factor addition was confirmed by Western analysis of phosphorylated MAPK and phosphorylated AKT in a separate plate of cells (data not shown). Cells were harvested at 30 minutes, 2 hours, 6 hours, 18 hours, and 24 hours after growth factor addition. DMSO (vehicle) treated cells were also harvested at each time point. RNA was prepared using RLT lysis reagent Qiagen spin columns according to manufacturer instructions.

Cell Culture and AKT Inhibitor Treatment

Duplicate cultures of LoVo colorectal carcinoma cells were seeded in 60 mm plates at a seeding density of approximately $1\times10^6$ cells/plate. Cells were allowed to adhere overnight. A small molecule inhibitor of AKT that preferentially inhibits the AKT1 isozyme was added to cells for 4 or 24 hours at a concentration of 5 µM. This concentration resulted in >90% inhibition of AKT phosphorylation by Western Blot (data not shown). The structure and AKT isozyme activity of this inhibitor (previously designated as "Akti-1") have been published (DeFeo-Jones et al., 2005, Mol. Cancer Ther. 4:271-279). DMSO (vehicle) treated cells were also harvested at each time point. After incubation with drug, RNA was prepared from cells using RLT lysis reagent and Qiagen spin columns according to manufacturer instructions. All treatments were performed in duplicate.

Gene Expression Profiling

For growth factor and AKT inhibitor treated cells, total RNA was isolated from cell lines and converted to fluorescently labeled cRNA that was hybridized to DNA oligonucleotide microarrays as described previously (Hughes et al., 2001, Nat. Biotechnol. 19:342-347; Marton et al., 1998, Nat. Med. 4:1293-1301). Briefly, 4 µg of total RNA from each treated sample was used to synthesize dsDNA through reverse transcription. cRNA was produced by in vitro transcription and labeled post-synthetically with Cy3 or Cy5. cRNA derived from growth factor or AKT inhibitor treated cells (experimental sample) was hybridized against cRNA derived from vehicle treated samples (reference sample). Two hybridizations were done with each cRNA sample pair using fluorescent dye reversal strategy. For growth factor treated cells, microarrays contained 23,880 probes representing genes or expressed sequence tags (GEO platform GPL2029). For AKT inhibitor treated cells, microarrays contained 23,658 probes representing genes or expressed sequence tags (GEO platform GPL3991). Probe sequences were chosen to maximize gene specificity and minimize the 3'-replication bias inherent in reverse transcription of mRNA. In addition, all microarrays contained approximately 2,000 control probes for quality control purposes. All probes on the microarrays were synthesized in situ with inkjet technology (Agilent Technologies, Palo Alto, Calif.; Hughes et al, 2001, Nat. Biotechnol. 19:342-347). After hybridization, arrays were scanned and fluorescence intensities for each probe were recorded. Ratios of transcript abundance (experimental to control) were obtained following normalization and correction of the array intensity data. Gene expression data was analyzed using Rosetta Resolver gene expression analysis software (version 7.0, Rosetta Biosoftware, Seattle, Wash.) and MATLAB (The MathWorks, Natick, Mass.).

Gene Function and Pathway Analysis

Gene function and pathway analysis was performed through the use of Ingenuity Pathway Analysis (Ingenuity® Systems, www.ingenuity.com). Canonical pathways analysis identified the pathways from the Ingenuity Pathways Analysis library of canonical pathways that were most significant to the data set. Genes from the data set that were identified as being part of the growth factor signature and were associated with a canonical pathway in the Ingenuity Pathways Knowledge Base were considered for the analysis. The significance of the association between the data set and the canonical pathway was measured in 2 ways: 1) A ratio of the number of genes from the data set that map to the pathway divided by the total number of genes that map to the canonical pathway is displayed; 2) Fischer's exact test was used to calculate a p-value determining the probability that the association between the genes in the dataset and the canonical pathway is explained by chance alone.

Calculation of Signature Scores

For cell line studies, gene expression was expressed as the log(10) ratio relative to time-matched vehicle treated cells. For tumor samples, gene expression was expressed as the log(10) ratio relative to the mean of all samples. The growth factor and c-MYC signatures contain genes that are up-regulated by growth factor or MYC addition ("up" arm) and genes that are down-regulated by growth factor or MYC addition ("down" arm). In these cases, signature scores were determined by calculating the mean expression of genes in the "up" arm minus the mean expression of genes in the "down"

arm. In the case of the proliferation and glycolysis signatures, all genes are regulated in the same direction and are correlated. Therefore, these signatures consist of only one arm, and the scores were calculated as the mean expression of all signature genes. The previously published signature of aberrant PTEN activity (Saal et al., 2007, Proc. Natl. Acad. Sci. USA 104:7564-7569) also contains two arms, and the signature score was calculated as the mean of the arm that does not contain PTEN minus the mean of the arm that does contain PTEN.

Results

A genome-wide analysis of gene expression changes induced by EGF, IGF, insulin, b-FGF, or heregulin treatment of HT-20 or MCF-7 cells was first performed. Each of these growth factors elicited a robust response across both cell lines. ANOVA analysis revealed that more than 4,500 genes are differentially expressed between growth factor and vehicle-treated samples with $p<0.001$ (see FIG. 24). As can be seen in the FIG. 24 heatmap, gene expression signatures elicited by the different growth factors are strikingly similar.

In order to quantify this similarity, we assessed how genes that are regulated by one growth factor behave when stimulated by another growth factor (FIGS. 25A, B). For each growth factor, we calculated the correlation between its signature and signatures elicited by other growth factors. The distributions of correlation coefficients are overwhelmingly positive, with a mean correlation coefficient exceeding 0.6.

To focus on the most robust and potentially most relevant signature genes, we selected a "core" set of genes that not only had a significant p-value for regulation but also had large fold change (>2 fold) at an early time point (2 hours), and continued to be regulated through 24 hours. Such a temporal pattern would be required for genes that represent early steps in the sequence of events induced by growth factors, and represent constitutive rather than transient changes in response to growth factor stimulation. By performing this procedure, we identified an 86 gene core "growth factor" signature; 44 genes were up-regulated ("up" arm), and 42 genes were down-regulated ("down" arm) by growth factors (FIG. 27, Table 11A, B).

TABLE 11

86 genes in the alternative growth factor signature. A) UP genes were upregulated by growth factor treatment, and

| Gene Symbol | Arm | Reference Transcript ID | Transcript SEQ ID NO: | Probe SEQ ID NO: |
|---|---|---|---|---|
| AMID | Up | NM_032797 | SEQ ID NO: 201 | SEQ ID NO: 202 |
| AREG | Up | NM_001657 | SEQ ID NO: 203 | SEQ ID NO: 204 |
| BTG3 | Up | NM_006806 | SEQ ID NO: 205 | SEQ ID NO: 206 |
| C12orf4 | Up | NM_020374 | SEQ ID NO: 207 | SEQ ID NO: 208 |
| C16orf61 | Up | NM_020188 | SEQ ID NO: 209 | SEQ ID NO: 210 |
| C18orf19 | Up | NM_152352 | SEQ ID NO: 211 | SEQ ID NO: 212 |
| C1orf135 | Up | NM_024037 | SEQ ID NO: 213 | SEQ ID NO: 214 |
| C20orf24 | Up | NM_018840 | SEQ ID NO: 215 | SEQ ID NO: 216 |
| C9orf25 | Up | NM_147202 | SEQ ID NO: 217 | SEQ ID NO: 218 |
| CEBPG | Up | NM_001806 | SEQ ID NO: 219 | SEQ ID NO: 220 |
| CORO1C | Up | NM_014325 | SEQ ID NO: 221 | SEQ ID NO: 222 |
| DLEU2 | Up | NM_006021 | SEQ ID NO: 223 | SEQ ID NO: 224 |
| DPH3 | Up | NM_206831 | SEQ ID NO: 225 | SEQ ID NO: 226 |
| EIF5 | Up | NM_001969 | SEQ ID NO: 227 | SEQ ID NO: 228 |
| ENO2 | Up | NM_001975 | SEQ ID NO: 229 | SEQ ID NO: 230 |
| HN1 | Up | NM_016185 | SEQ ID NO: 231 | SEQ ID NO: 232 |
| HSP90AA1 | Up | NM_005348 | SEQ ID NO: 233 | SEQ ID NO: 234 |
| HSPA4L | Up | NM_014278 | SEQ ID NO: 235 | SEQ ID NO: 236 |
| IFRD1 | Up | NM_001550 | SEQ ID NO: 237 | SEQ ID NO: 238 |
| IMPAD1 | Up | NM_017813 | SEQ ID NO: 239 | SEQ ID NO: 240 |
| KLK6 | Up | NM_002774 | SEQ ID NO: 241 | SEQ ID NO: 242 |
| KPNA4 | Up | NM_002268 | SEQ ID NO: 243 | SEQ ID NO: 244 |
| LRP8 | Up | NM_004631 | SEQ ID NO: 245 | SEQ ID NO: 246 |
| MALL | Up | NM_005434 | SEQ ID NO: 247 | SEQ ID NO: 248 |
| MTHFD1L | Up | NM_015440 | SEQ ID NO: 249 | SEQ ID NO: 250 |
| PADI1 | Up | NM_013358 | SEQ ID NO: 251 | SEQ ID NO: 252 |
| PFKP | Up | NM_002627 | SEQ ID NO: 253 | SEQ ID NO: 254 |
| PNPT1 | Up | NM_033109 | SEQ ID NO: 255 | SEQ ID NO: 256 |
| PSMC4 | Up | NM_006503 | SEQ ID NO: 257 | SEQ ID NO: 258 |
| RPS6KA3 | Up | NM_004586 | SEQ ID NO: 259 | SEQ ID NO: 260 |
| S100A2 | Up | NM_005978 | SEQ ID NO: 261 | SEQ ID NO: 262 |
| SERPINB5 | Up | NM_002639 | SEQ ID NO: 263 | SEQ ID NO: 264 |
| SERPINB8 | Up | NM_002640 | SEQ ID NO: 265 | SEQ ID NO: 266 |
| SLC7A1 | Up | NM_003045 | SEQ ID NO: 267 | SEQ ID NO: 268 |
| SRXN1 | Up | NM_080725 | SEQ ID NO: 269 | SEQ ID NO: 270 |
| TIPIN | Up | NM_017858 | SEQ ID NO: 271 | SEQ ID NO: 272 |
| TRIB2 | Up | NM_021643 | SEQ ID NO: 273 | SEQ ID NO: 274 |
| TUBB3 | Up | NM_006086 | SEQ ID NO: 275 | SEQ ID NO: 276 |
| TUBB4 | Up | NM_006087 | SEQ ID NO: 277 | SEQ ID NO: 278 |
| TUBG1 | Up | NM_001070 | SEQ ID NO: 279 | SEQ ID NO: 280 |
| UBQLN1 | Up | NM_013438 | SEQ ID NO: 281 | SEQ ID NO: 282 |
| UCHL5 | Up | NM_016017 | SEQ ID NO: 283 | SEQ ID NO: 284 |
| ULBP2 | Up | NM_025217 | SEQ ID NO: 285 | SEQ ID NO: 286 |
| WDR4 | Up | NM_018669 | SEQ ID NO: 287 | SEQ ID NO: 288 |

TABLE 11B

DOWN genes were downregulated by growth factor treatment.

| Gene | Direction | Accession | SEQ ID | SEQ ID |
|---|---|---|---|---|
| ABCC5 | Down | NM_005688 | SEQ ID NO: 289 | SEQ ID NO: 290 |
| ATP6V1B1 | Down | NM_001692 | SEQ ID NO: 291 | SEQ ID NO: 292 |
| ATXN3 | Down | NM_004993 | SEQ ID NO: 293 | SEQ ID NO: 294 |
| BCAS1 | Down | NM_003657 | SEQ ID NO: 295 | SEQ ID NO: 296 |
| BCL2L11 | Down | NM_006538 | SEQ ID NO: 297 | SEQ ID NO: 298 |
| C1orf78 | Down | NM_018166 | SEQ ID NO: 299 | SEQ ID NO: 300 |
| C20orf108 | Down | NM_080821 | SEQ ID NO: 301 | SEQ ID NO: 302 |
| C20orf38 | Down | NM_018327 | SEQ ID NO: 303 | SEQ ID NO: 304 |
| C2orf27 | Down | NM_013310 | SEQ ID NO: 305 | SEQ ID NO: 306 |
| C5orf4 | Down | NM_016348 | SEQ ID NO: 307 | SEQ ID NO: 308 |
| C6orf35 | Down | NM_018452 | SEQ ID NO: 309 | SEQ ID NO: 310 |
| CALCOCO1 | Down | NM_020898 | SEQ ID NO: 311 | SEQ ID NO: 312 |
| CAPN13 | Down | NM_033559 | SEQ ID NO: 313 | SEQ ID NO: 314 |
| CHES1 | Down | NM_005197 | SEQ ID NO: 315 | SEQ ID NO: 316 |
| CRBN | Down | NM_016302 | SEQ ID NO: 317 | SEQ ID NO: 318 |
| CYHR1 | Down | NM_032687 | SEQ ID NO: 319 | SEQ ID NO: 320 |
| DEPDC6 | Down | NM_022783 | SEQ ID NO: 321 | SEQ ID NO: 322 |
| DHRS8 | Down | NM_016245 | SEQ ID NO: 323 | SEQ ID NO: 324 |
| DNAL4 | Down | NM_005740 | SEQ ID NO: 325 | SEQ ID NO: 326 |
| EIF4A2 | Down | NM_001967 | SEQ ID NO: 327 | SEQ ID NO: 328 |
| EPHX2 | Down | NM_001979 | SEQ ID NO: 329 | SEQ ID NO: 330 |
| ERBB3 | Down | NM_001982 | SEQ ID NO: 331 | SEQ ID NO: 332 |
| GPR30 | Down | NM_001505 | SEQ ID NO: 333 | SEQ ID NO: 334 |
| HIST1H2AC | Down | NM_003512 | SEQ ID NO: 335 | SEQ ID NO: 336 |
| HIST1H2BD | Down | NM_021063 | SEQ ID NO: 337 | SEQ ID NO: 338 |
| HIST3H2A | Down | NM_033445 | SEQ ID NO: 339 | SEQ ID NO: 340 |
| HOXB13 | Down | NM_006361 | SEQ ID NO: 341 | SEQ ID NO: 342 |
| ING4 | Down | NM_016162 | SEQ ID NO: 343 | SEQ ID NO: 344 |
| MLLT7 | Down | NM_005938 | SEQ ID NO: 345 | SEQ ID NO: 346 |
| OVGP1 | Down | NM_002557 | SEQ ID NO: 347 | SEQ ID NO: 348 |
| PCMTD1 | Down | NM_052937 | SEQ ID NO: 349 | SEQ ID NO: 350 |
| PCMTD2 | Down | NM_018257 | SEQ ID NO: 351 | SEQ ID NO: 352 |
| PDIA4 | Down | NM_004911 | SEQ ID NO: 353 | SEQ ID NO: 354 |
| PLA2G10 | Down | NM_003561 | SEQ ID NO: 355 | SEQ ID NO: 356 |
| PLEKHG4 | Down | NM_015432 | SEQ ID NO: 357 | SEQ ID NO: 358 |
| POU2F3 | Down | NM_014352 | SEQ ID NO: 359 | SEQ ID NO: 360 |
| RAMP1 | Down | NM_005855 | SEQ ID NO: 361 | SEQ ID NO: 362 |
| SEMA3G | Down | NM_020163 | SEQ ID NO: 363 | SEQ ID NO: 364 |
| SEPP1 | Down | NM_005410 | SEQ ID NO: 365 | SEQ ID NO: 366 |
| SIDT2 | Down | NM_015996 | SEQ ID NO: 367 | SEQ ID NO: 368 |
| TNS3 | Down | NM_022748 | SEQ ID NO: 369 | SEQ ID NO: 370 |
| ZBTB44 | Down | NM_014155 | SEQ ID NO: 371 | SEQ ID NO: 372 |

Biological Analysis of Genes in the Growth Factor Signature

In order to gain insights into the biological processes and known signaling pathways involved in growth factor signaling, we performed biological pathway analysis to uncover relationships among genes in the growth factor signature. We utilized the Ingenuity Pathway Analysis (IPA; http://www.ingenuity.com) software tool to identify canonical signaling pathways that are statistically enriched among growth factor signature genes. Other groups have previously used the IPA tool to identify biological pathways involved in complex processes including inflammation, glucocorticoid receptor signaling, and cancer (Calvano et al., 2005, Nature 437:1032-1037; Kasamatsu et al., 2005, Int. J. Biochem. Cell. Biol. 37:1869-1880; Phuc et al., 2005, PLoS Genet. 1:e16). Among genes up-regulated by growth factors, enriched pathways included ubiquitination, neuregulin signaling, nitric oxide signaling, and glycolysis/gluconeogenesis (FIG. 26). Among genes down-regulated by growth factors, PTEN signaling was most significantly enriched. As neuregulins are ligands for receptor tyrosine kinases of the ErbB family (Falls, 2003, Exp. Cell. Res. 284:14-30) and previous studies have demonstrated that AKT stimulates glucose transport and metabolism (Elstrom et al., 2004, Cancer Res. 64:3892-3899; Lum et al., 2007, Genes Dev. 21:1037-1049; Plas and Thompson, 2005, Oncogene 24:7435-7442), up-regulation of these pathways is consistent with known biology of growth factor signaling. Down-regulation of genes involved in PTEN signaling is also consistent with PTEN's role as a negative regulator of PI3K activity (Cantley et al., 1999, Proc. Natl. Acad. Sci. USA 96:4240-4245), and suggests that growth factors and PTEN have inverse effects on an overlapping set of genes. These results support the hypothesis that the growth factor signature is reading out cellular biology reflective of increased signaling through growth factor receptors.

Comparison of the Growth Factor Signature to Other Pathway Signatures

Activation of c-MYC and increased proliferation are known downstream effects of growth factor signaling (Bouchard et al., 2004, EMBO J. 23:2830-2840; Bernard and Eilers, 2006, Results Probl. Cell. Differ. 42:329-342), and recent studies have generated gene expression signatures that monitor levels of c-MYC (Bild et al., 2006, Nature 439:353-357) and proliferation (Dai et al., 2005, Cancer Res. 65:4059-4066). Therefore, we assessed the timing and kinetics of growth factor-induced regulation of the growth factor signature relative to previously published c-MYC and proliferation signatures. The temporal pattern of activation of the c-MYC, proliferation, and growth factor signatures averaged across cell lines and growth factors is shown in FIG. 28. While the growth factor signature is induced at 2 hours, and remains significantly induced through 24 hours, the c-MYC signature is less robustly induced and is transiently regulated, with maximal induction at 6 hours. In addition, the proliferation signature is only induced at later time points, with significant induction observed starting at 12 hours. These data suggest that the growth factor signature captures events more proximal to stimulation of growth factor receptors, and that these events are maintained as long as growth factor receptors remain activated.

Negative Feedback Induced by Growth Factors

Figures 29A, 29B, 29C, 29D:
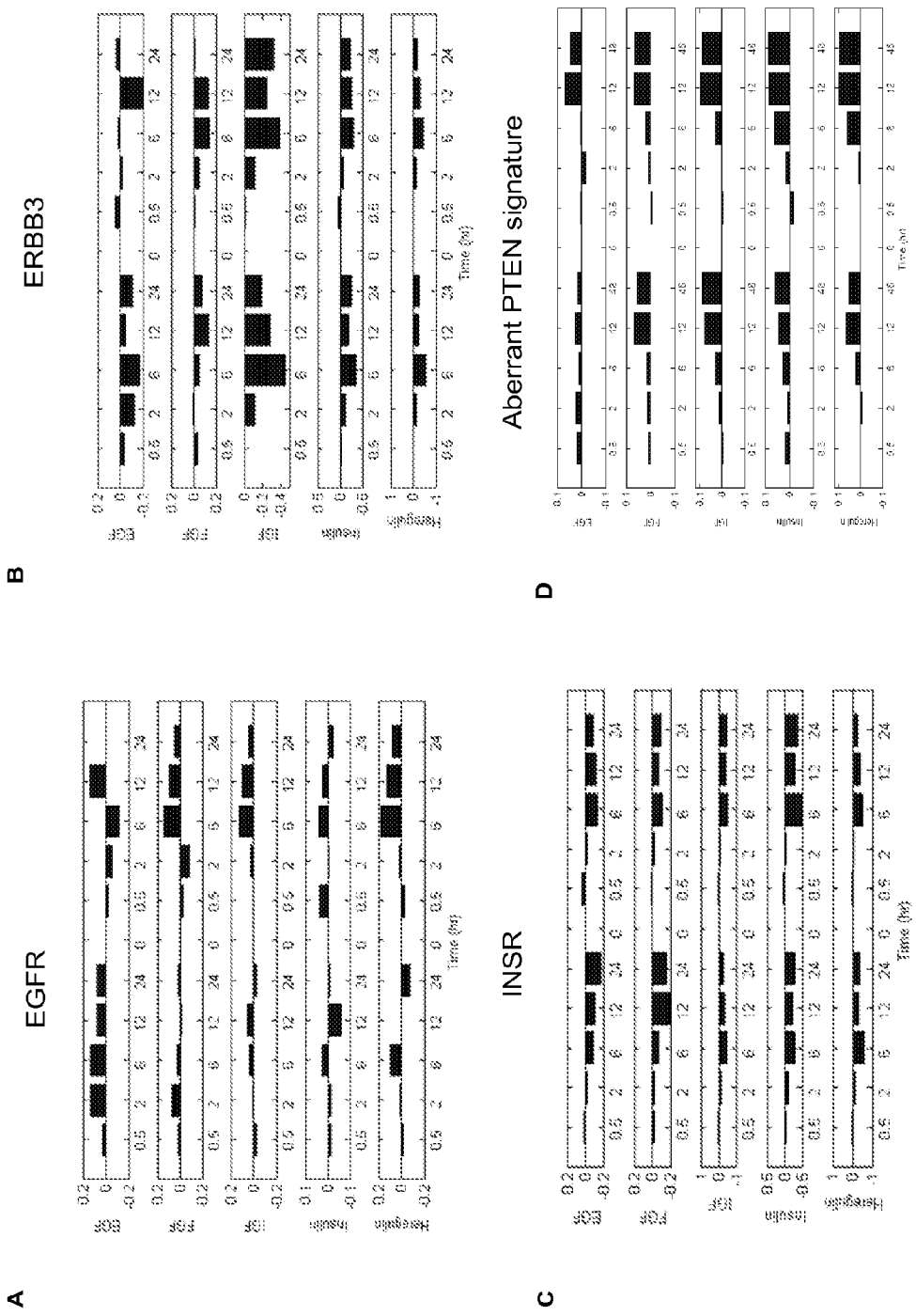

Growth factor receptors are subject to negative regulatory mechanisms that normally function to prevent aberrant signaling (Sweeney and Carraway, 2004, 90:289-293), and recent studies involving profiling of protein phosphorylation and gene expression have demonstrated the existence of a kinetically defined group of genes that functions to inhibit the early events of growth factor signaling (Amit et al., 2007, Nat. Genet. 39:503-512). When assessing genes that were consistently down-regulated by growth factors, we noted that the epidermal growth factor receptor family member ERBB3 was significantly down-regulated by all growth factors in both cell lines (Table 11). As recent studies have demonstrated that ligand binding can down-regulate ERBB3 through ubiquitination followed by lysosomal degradation (Cao et al., 2007, Mol. Cell. Biol. 27:2180-2188), we assessed how stimulation of cells with EGF, IGF, insulin, b-FGF, or heregulin impacts the mRNA expression of growth factor receptors (FIG. 29). Treatment of cells with EGF or other growth factors did not result in down-regulation of EGFR expression (FIG. 29A). In contrast, treatment of cells with EGF, IGF, insulin, b-FOE, or heregulin resulted in significant down-regulation of ERBB3 and INSR (FIGS. 29B, 29C). These data suggest that ERBB3 and INSR are highly sensitive to feedback inhibition, and are quickly down-regulated in response to growth factor signaling, even when these signals are propagated through other growth factor receptors. As such, care should be taken when using mRNA levels of ERBB3 or INSR as a surrogate for activity of signaling through these receptors.

As PTEN pathway signaling was significantly enriched within genes down-regulated by growth factors (FIG. 26), we then assessed the effect of growth factors on expression of a recently published signature of aberrant PTEN activity (Saal et al., 2007, Proc. Natl. Acad. Sci. USA 104:7564-7569). As shown in FIG. 29D, treatment of cells with growth factors resulted in the consistent up-regulation of the aberrant PTEN signature. This result demonstrates that growth factors activate genes that are also activated by PTEN loss, and supports the notion that a significant component of the growth factor signature reflects the antagonism of signals associated with PTEN activity.

Inhibition of the Growth Factor Signature by PI3K Pathway Inhibitors

To further validate the growth factor signature, we leveraged signatures of drug response from the connectivity map dataset (Lamb et al., 2006, Science 313:1929-1935). This dataset comprises mRNA expression data for 164 distinct small molecules, representing 453 individual compound treatment experiments. These small molecule inhibitors include the PI3K inhibitors wortmannin and LY-294002 and the mTOR inhibitor sirolimus. We surmised that if the growth factor signature truly represents activation of the PI3K pathway, these compounds should have an inhibitory effect on the signature. Each of these compounds was shown to be a highly significant inhibitor of the growth factor signature. As shown in Table 12, sirolimus, wortmannin, and LY-294002 were the number 1, 2, and 3 ranked compounds in terms of significance of signature inhibition of all compounds in this dataset. In contrast, other perturbagens in the connectivity map dataset either have no effect, a less significant inhibitory effect, or an activating effect on the growth factor signaling signature. The previously described proliferation and MYC signatures were also inhibited by sirolimus, wormannin, and LY-294002, but with a less extreme rank of these three compounds in the inhibitory end of the distribution. For example, while LY-294002 was the top ranked compound in terms of significance of proliferation signature inhibition, sirolimus was ranked fifth, and wortmannin was ranked $23^{rd}$ (Table 12). Inhibition of the proliferation signature by wortmannin was not statistically significant. This result suggests that the growth factor signaling signature is most significantly inhibited by PI3K pathway inhibitors and that this inhibition is not specific to any one PI3K pathway component. In addition, this result also suggests that the growth factor signature and proliferation signature report on different aspects of biology, as their pattern of inhibition differed among compounds.

TABLE 12

Rank of sirolimus, wortmannin, and LY-294002 in terms of significance of signature inhibition

| Signature | Rank | Compound | Enrichment | p-value |
|---|---|---|---|---|
| Growth Factor Signaling Pathway | 1 | Sirolimus | −0.865 | 0 |
|  | 2 | Wortmannin | −0.776 | 0 |
|  | 3 | LY-294002 | −0.748 | 0 |
| Proliferation | 1 | LY-294002 | −0.527 | 0.0002 |
|  | 5 | Sirolimus | −0.482 | 0.0125 |
|  | 23 | Wortmannin | −0.387 | 0.1361 |
| c-MYC | 1 | Sirolimus | −0.68 | 0 |
|  | 2 | LY-294002 | −0.602 | 0 |
|  | 7 | wortmannin | −0.561 | 0.0065 |

Inhibition of the Growth Factor Signature by Inhibition of AKT1

In addition to PI3K and mTOR inhibitors, we wished to assess the effect of AKT inhibition on the growth factor signature. For this purpose, we leveraged internally developed, allosteric, isoform-specific inhibitor of AKT1 (DeFeo-Jones et al., 2005, Mol. Cancer Ther. 4:271-279). We treated the colorectal carcinoma cell line LoVo with vehicle or 5 μM AKT1 inhibitor for 4 or 24 hours and assessed resultant gene expression profiles. As shown in FIG. 30, inhibition of AKT1 caused inhibition of the growth factor signaling signature relative to vehicle treatment at both time points. Inhibition of the growth factor signaling signature exceeded inhibition of the c-MYC and proliferation signatures at 4 hours, and was roughly equivalent to cMYC signature at 24 hours. These data indicate that the growth factor signature responds at early time points to treatments that inhibit PI3K pathway signaling.

Considered together with results from the connectivity dataset, these data demonstrate that regulation of the growth factor signature is not specific to one component of the RTK-PI3K-AKT-mTOR signaling axis; rather, this signature is consistently regulated by activation or inhibition of this pathway at multiple points along this signaling axis. This may be expected, as growth factor signaling elicits a protein phosphorylation cascade, ultimately affecting the expression of a variety of genes once the signal reaches the nucleus. Therefore, it seems logical that inhibiting the phosphorylation cascade at proximal or distal points along this axis would result in similar effects on mRNA expression in the nucleus.

Assessment of the Growth Factor Signature in Human Tumors

Figures 31A, 31B, 31C, 31D:
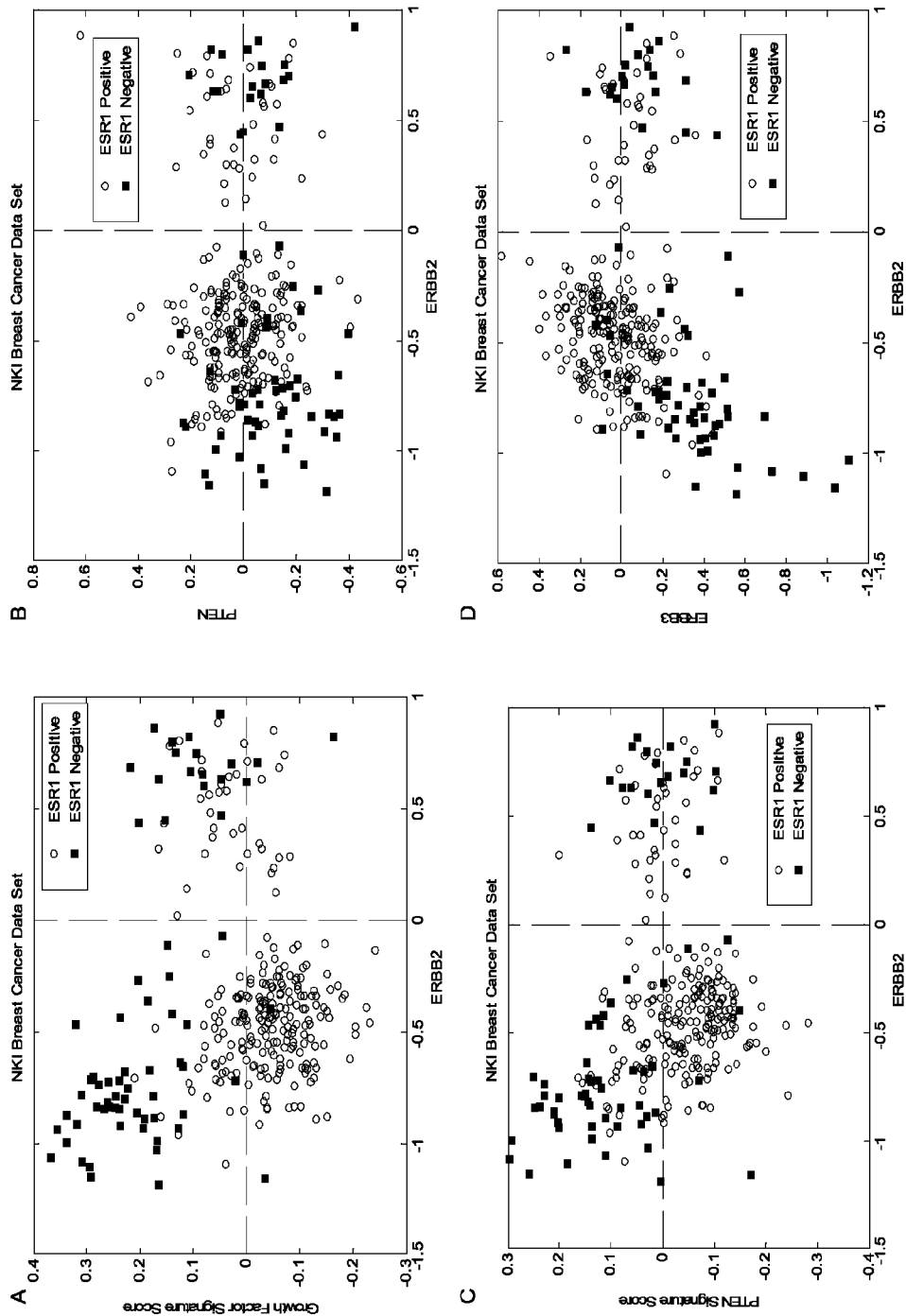

As the growth factor signature is activated by growth factors and inhibited by PI3K pathway inhibitors, we reasoned that levels of the growth factor signaling signature in tumor samples could be used to stratify tumors according to predicted levels of PI3K pathway activity. In order to identify subsets of tumors with high predicted levels of PI3K signaling, we assessed the growth factor signature in primary breast carcinoma gene expression profiles from van de Vijver et al. (2002, N. Engl. J. Med. 347:1999-2009). Estrogen receptor status was determined as described previously (Van de Vijver et al., 2002, N. Engl. J. Med. 347:1999-2009). As shown in FIG. 31A, the subset of breast cancers with the highest levels of the growth factor signature are the ERBB2 low, ER negative subset. These tumors also exhibit low expression of the progesterone receptor (PR; data not shown), and therefore represent the "triple negative" subset of breast cancers. This subset is followed by ERBB2 high and then ER positive tumors in order of decreasing baseline levels of the growth factor signature. This data suggests that ERBB2 is not the largest driver of PI3K pathway signaling in breast tumors; rather, some aspect of triple negative tumors is driving the growth factor signaling signature to the highest levels. Interestingly, triple negative breast tumors are associated with the worst outcomes, suggesting that PI3K signaling may underlie poor survival in breast cancer (Harris et al., 2006, Breast Cancer Res. 8:R66).

As demonstrated above, growth factors and PTEN have antagonistic effects on an overlapping set of genes. Therefore, we hypothesized that loss of PTEN may be a central driver of the growth factor signature in triple negative breast tumors. To test this, we assessed mRNA levels of PTEN and levels of the previously described signature of aberrant PTEN activity (Saal et al, 2007, Proc. Natl. Acad. Sci. USA 104: 7564-7569) across breast tumors. Consistent with our hypothesis, triple negative breast tumors showed low levels of PTEN mRNA and the highest levels of the aberrant PTEN signature (FIGS. 31B, C). This is consistent with previous reports that PTEN loss occurs mainly in ER/PR negative breast tumors (Saal et al, 2005, Cancer Res. 65:2554-2559). These data suggest that while ERBB2 amplification leads to increased PI3K pathway signaling relative to the ER positive subset, loss of PTEN in triple negative tumors contributes to the observation that this subset shows the highest levels of the growth factor signaling signature.

As we previously observed that ERBB3 mRNA expression is highly sensitive to feedback inhibition caused by growth factor stimulation in vitro, we also assessed ERBB3 expression across breast tumors. Consistent with in vitro observations, ERBB3 mRNA is expressed at the lowest levels in triple negative breast tumors, the same sub-population in which the growth factor signature is the highest (FIG. 31D). This result demonstrates that the inverse relationship between high growth factor signaling signature and low ERBB3 expression observed in vitro is sustained in the in vivo setting. While it was the addition of growth factors that lead to down-regulation of ERBB3 mRNA in vitro, the correlation between PTEN and ERBB3 mRNA expression in this dataset suggests that PTEN loss is a significant contributor to PI3K pathway activation and subsequent ERBB3 mRNA down-regulation in triple negative breast cancers. Therefore, as upstream activators of PI3K signaling (i.e., ERBB3) can be sensitive to feedback inhibition in vitro and show similar relationships with pathway activation readouts in vivo, caution should be applied when using mRNA levels of a single pathway activator as a surrogate for overall pathway activity in vivo.

Glycolysis and Proliferation in Breast Tumor Subsets

In addition to the down-regulation of PTEN activity, we next assessed other aspects of biology that could underlie observations of increased growth factor signaling in triple negative breast tumors relative to ERBB2 positive tumors. As multiple breast cancer profiling studies have suggested that proliferation is high in the ER negative subset of breast tumors (reviewed in Sotiriou et al., 2007, Nat. Rev. Cancer 7:545-553), and one outcome of PI3K pathway activation is increased proliferation (Vivanco and Sawyers, 2002, Nat. Rev. Cancer 2:489-501), one possible explanation is that proliferation is a main driver of increased growth factor signaling signature levels in triple negative breast tumors. However multiple recent studies have demonstrated that AKT activation causes cells to undergo a metabolic conversion from oxidative phosphorylation to aerobic glycolysis (Elstrom et al, 2004, Cancer Res. 64:3892-3899; Plas and Thompson, 2005, Oncogene 24:7435-7442), and glycolysis/gluconeogenesis pathway genes were significantly enriched among growth factor signaling signature genes up-regulated by growth factor treatment of cell lines (FIG. 26). As such, we hypothesized that increased glycolysis was a contributing factor to the observed increase in growth factor signature levels in triple negative breast tumors relative to the ERBB2 positive population.

To test this, we first identified a glycolysis "signature" (Table 13). The glycolysis signature was identified by performing correlation analysis in the NKI breast tumor dataset (Van de Vijver et al., 2002, N. Engl. J. Med. 347:1999-2009). This analysis was performed by taking the genes in the growth factor signaling signature as seed genes and finding a cluster of genes that are most tightly correlated with this seed (correlation p-value<0.0001). Correlation analysis with several genes from the growth factor signaling signature, such as PFKP, CORO1C, TUBB3, and TUBB4, identified a set of 39 tightly correlated genes. The core gene set derived from this correlation analysis contained several other known genes involved in glycolysis, such as LDHA. Ingenuity analysis of the glycolysis signature showed that this gene set is highly enriched for glycolysis related genes (data not shown).

TABLE 13

Genes in the glycolysis signature

| Gene Symbol | Reference Transcript ID | SEQ ID NO: | Probe SEQ ID NO: |
|---|---|---|---|
| ACTR3 | NM_005721 | SEQ ID NO: 373 | SEQ ID NO: 374 |
| ADAMTS7 | NM_014272 | SEQ ID NO: 375 | SEQ ID NO: 376 |
| ADM | NM_001124 | SEQ ID NO: 377 | SEQ ID NO: 378 |
| ATF7IP | NM_018005 | SEQ ID NO: 379 | SEQ ID NO: 380 |
| BAIAP2L1 | NM_018842 | SEQ ID NO: 381 | SEQ ID NO: 382 |
| C10orf7 | NM_006023 | SEQ ID NO: 383 | SEQ ID NO: 384 |
| C16orf57 | NM_024598 | SEQ ID NO: 385 | SEQ ID NO: 386 |
| CA9 | NM_001216 | SEQ ID NO: 387 | SEQ ID NO: 388 |
| CDC20 | NM_001255 | SEQ ID NO: 389 | SEQ ID NO: 390 |
| CDCP1 | NM_022842 | SEQ ID NO: 391 | SEQ ID NO: 392 |
| CORO1C | NM_014325 | SEQ ID NO: 221 | SEQ ID NO: 222 |
| CTPS | NM_001905 | SEQ ID NO: 393 | SEQ ID NO: 394 |
| ENO1 | NM_005945 | SEQ ID NO: 395 | SEQ ID NO: 396 |
| GAPDH | NM_002046 | SEQ ID NO: 397 | SEQ ID NO: 398 |
| GAPDHS | NM_014364 | SEQ ID NO: 399 | SEQ ID NO: 400 |
| HRB | NM_004504 | SEQ ID NO: 401 | SEQ ID NO: 402 |
| KCMF1 | NM_020122 | SEQ ID NO: 403 | SEQ ID NO: 404 |
| LDHA | NM_005566 | SEQ ID NO: 405 | SEQ ID NO: 406 |
| MLZE | NM_031415 | SEQ ID NO: 407 | SEQ ID NO: 408 |
| MSN | NM_002444 | SEQ ID NO: 409 | SEQ ID NO: 410 |
| NDRG1 | NM_006096 | SEQ ID NO: 411 | SEQ ID NO: 412 |
| PDIA6 | NM_005742 | SEQ ID NO: 413 | SEQ ID NO: 414 |
| PFKP | NM_002627 | SEQ ID NO: 253 | SEQ ID NO: 254 |
| PGM1 | NM_002633 | SEQ ID NO: 415 | SEQ ID NO: 416 |
| PSMB2 | NM_002794 | SEQ ID NO: 417 | SEQ ID NO: 418 |
| QSCN6L1 | NM_181701 | SEQ ID NO: 419 | SEQ ID NO: 420 |
| S100A11 | NM_005620 | SEQ ID NO: 421 | SEQ ID NO: 422 |
| SEPHS1 | NM_012247 | SEQ ID NO: 423 | SEQ ID NO: 424 |
| SLC16A3 | NM_004207 | SEQ ID NO: 425 | SEQ ID NO: 426 |
| SLC2A1 | NM_006516 | SEQ ID NO: 427 | SEQ ID NO: 428 |
| SLC43A3 | NM_014096 | SEQ ID NO: 429 | SEQ ID NO: 430 |
| SLC4A1 | NM_000342 | SEQ ID NO: 431 | SEQ ID NO: 432 |
| SOD2 | NM_000636 | SEQ ID NO: 433 | SEQ ID NO: 434 |
| SUV39H2 | NM_024670 | SEQ ID NO: 435 | SEQ ID NO: 436 |
| SYNCRIP | NM_006372 | SEQ ID NO: 437 | SEQ ID NO: 438 |

TABLE 13-continued

Genes in the glycolysis signature

| Gene Symbol | Reference Transcript ID | SEQ ID NO: | Probe SEQ ID NO: |
|---|---|---|---|
| TFG | NM_006070 | SEQ ID NO: 439 | SEQ ID NO: 440 |
| TPI1 | NM_000365 | SEQ ID NO: 441 | SEQ ID NO: 442 |
| UCK2 | NM_012474 | SEQ ID NO: 443 | SEQ ID NO: 444 |
| USP6NL | NM_014688 | SEQ ID NO: 445 | SEQ ID NO: 446 |

As shown in FIG. 32, while both ERBB2 positive and triple negative breast tumors exhibit equivalently high levels of the proliferation signature, triple negative tumors have increased expression of the glycolysis signature relative to ERBB2 positive tumors. In addition, FIG. 33 shows that treatment of HT-29 and MCF-7 cells with growth factors resulted in overall up-regulation of the glycolysis signature. These data suggested that PI3K pathway activation by growth factors leads to an increase in glycolysis, and that the increase in growth factor signature levels in triple negative breast tumors relative to ERBB2 positive breast tumors is reflective of increased glycolysis rather than simply increased proliferation. As AKT activation leads to increased glycolysis, this data, taken together with the observed deregulation of PTEN signaling in triple negative tumors, suggests that triple negative breast tumors have high levels of PI3K pathway signaling relative to other breast cancer subsets.

Example 12

Growth Factor Signaling Pathway Signature as an Early Readout of IGF1R Compound Efficacy in Xenografts NMRI female nu/nu mice were subcutaneously implanted with patient-derived tumor xenografts: lung adenocarcinoma LXFA 526, LXFA 629, LXFA 677, LXFA 749 and LXFA 1012; squamous cell lung carcinoma LXFE, 211, LXFE 397, LXFE 409 and LXFE 1422; small cell lung cancer LXFS 538, LXFS 573 and LXFS 615; colorectal carcinoma CXF 94LX, CXF 158, CXF 280, CXF 975, CXF 1103 and CXF 1729; renal cell carcinoma RXF 393, RXF 423, RXF 631 and RXF 1220; gastric cancer GXF 97, GXF 251 and GXF 281; ovarian cancer OVXF 550, OVXF 899, OVXF 1023, OVXF 1353 and OVXF 1544 (Oncotest GmbH, Freiburg, Germany). All tumor xenografts were derived from surgical specimen from human patients and directly transplanted into nude mice for propagation. Tumor xenografts were passaged in nude mice until establishment of a stable growth pattern. Master stocks of early passage xenografts were frozen in liquid nitrogen. A particular master stock batch is typically only used for about 20 further passages. Tumor fragments were obtained from xenografts in serial passage in nude mice. After removal of tumors from donor mice, they were cut into fragments (1-2 mm diameter) and placed RPMI 1640 culture medium until subcutaneous implantation. Recipient mice were anesthetized by inhalation of isoflurane. Tumor fragments (1-2 per mouse) were transplanted subcutaneously into the backs of recipient mice. Animals carrying at least one tumor of appropriate size (mean tumor diameter 6-8 mm, minimum acceptable tumor diameter 5 mm) were considered for randomization into treatment and vehicle control groups.

MK-0646 IGF1R monoclonal antibody (U.S. Pat. No. 7,241,444) was diluted to a final dosing concentration of 2 mg/mL with 20 mM—L Histidine, 150 mM NaCl, 0.5% PS_80 w/w pH 6.5 at ratio of 1:5.65. The diluted treatment solution was administered at an application volume of 250 µl/mouse for the dose level of 500 µg/mouse. The control vehicle was 20 mM-L Histidine, 150 mM NaCl, 0.5% PS-80 w/w, pH6.5. Vehicle was administered at 250 µl/mouse. IGF1R monoclonal antibody and control vehicle were injected intraperitoneally. Test and control mice were injected once a week on the same days. The number of injections ranged from 2 to 7, depending on the duration of the experiment. Experiments were terminated when one of the limits set by the German animal regulations was met.

Each experiment consisted of a vehicle control group (Group 1) receiving 20 mM-L Histidine, 150 mM NaCl, 0.5% PS-80 w/w, pH6.5 at 250 µL/mouse ip once weekly and one group treated with IGF-1R at 500 µg/mouse ip once weekly (Group 2). For sample collection purposes each experiment also comprised two groups (Groups 3 and 4) receiving a single therapy either with the vehicle or with IGF-1R at the same dose levels. According to the study protocol the group size in the efficacy groups (Groups 1 and 2) was 7 mice while the sample collection groups (Group 3 and 4) contained 3 nude mice each. In the experiments with CXF 1103 and RXF 631 bearing mice the efficacy groups contained 8 mice and group size in the efficacy groups of the experiment with LXFE 211 bearing nude mice was 9. The vehicle control group of the experiment with RXF 393 bearing nude mice consisted of 6 mice. The sample collection groups of the experiment with LXFS 538 both contained 4 mice and the sample collection vehicle control group of the experiment with CXF 975 bearing nude mice also contained 4 mice.

Relative volumes of individual tumors (RTVs) for Day x were calculated by dividing the individual tumor volume on Day X (Tx) by the individual volume of the same tumor on Day 0 (T₀) multiplied by 100%.

$$Ind.\ RTV\ (Day_x) = \frac{T_x}{T_0} \times 100\%$$

Group tumor volumes were expressed as the median RTV of all tumors in a group (group median RTV). For calculations only the volumes of tumors in mice that were alive on Day x were considered. Group median RTV values were used for drawing growth curves and for treatment evaluation.

Tumor inhibition on a particular day (T/C in %) was calculated from the ratio of the median RTV values of the test versus control groups multiplied by 100%.

$$T/C\ (Day_x) = \frac{\text{Median relative tumor volume of the test group Day}_x}{\text{Median relative tumor volume of the control group Day}_x} \times 100\%$$

The minimum T/C % value recorded for a particular test group during an experiment represented the maximum antitumor activity for the respective treatment.

Animals of Groups 1 and 2 had a range of termination dates from Day 14 to Day 45 depending on when the guidelines for sacrificing experimental mice were met. Animals of Groups 3 and 4 were sacrificed for sample collection when the tumors had volumes between 400 and 600 mm³ and 24 hours after a single treatment with either the control vehicle (Group 3) or IGF1R (Group 4). Tumors were cut into two parts, snap frozen in liquid nitrogen and stored at −80° C. RNA was harvested from both vehicle-treated and MK0646-treated samples as previously described for hybridization to DNA oligonucleotide arrays.

Regulation of the growth factor signaling pathway signature by MK-0646 was assessed by comparing mean gene expression profiles of MK0646 treated samples for each xenograft to the mean gene expression profile of the vehicle treated samples. The log(10) ratio of expression in the MK-0646 treated samples relative to the vehicle treated samples was calculated for every probe on the microarray. The growth factor signaling pathway signature score was calculated as the mean log(10) ratio of the genes in the "up" arm of the signature (see Table 5a) minus the mean log(10) ratio of the genes in the "down" arm of the signature (see Table 5b). A post/pre-dose ratio of the growth factor signaling pathway signature score was then calculated and compared to the tumor inhibition T/C ratio for each xenograft (see FIG. 34). A lower GFS score post/pre dose ratio demonstrates greater inhibition of signaling of this pathway by MK-0646 treatment. A lower T/C ratio demonstrates greater growth inhibition by MK-0646 treatment. As shown in FIG. 34, xenografts shown in light gray had strong tumor inhibition following MK-0646 treatment (LXFA-629, MAXF-713, OVXF-899, and CSF-94LX). Xenografts shown in medium gray had a moderate response following MK-0646 treatment (SXF-1186, CSF-280, CSF-1729), and xenografts shown in dark gray had minimal or no response to MK-0646 treatment. As shown in FIG. 34, two xenografts (MAXF-713 and LXFA-629) showing the most tumor inhibition (T/C ratio) also had a low growth factor signaling score post/pre-dose ratio, showing greater inhibition of signaling of this pathway following MK-0646 treatment. These data suggest that the growth factor signaling pathway signature score could be used as an early readout of compound efficacy.

REFERENCE TO SEQUENCE LISTING SUBMITTED ELECTRONICALLY

The sequence listing of the present application is being submitted electronically via EFS-Web as an ASCII formatted sequence listing with a file name "ROSONC0232USPCT-SEQTXT-22SEP2010", creation date of Sep. 17, 2010 and a size of 883 KB. This sequence listing submitted via EFS-Web is part of the specification and is herein incorporated by reference in its entirety.

SEQUENCE LISTING (446 sequences)

SEQ ID NO: 1 - DNA, 3949 bp, Homo sapiens
aggagccgacgggcgctcgcaggctcagcgcgcgctgcccgcggcaggacccggccgcctccgccgccgccgccgcccctaagcctcccgaagccatggccgggctcggccaccccgccgccttcggccgggccacccacgccgtggtgcgggcgctacccgagtcgctcggccagcacgcgctgagaagcgccaagggcgaggaggtggacgtcgcccgcgcggaacggcagcaccagctctacgtgggcgtgctgggcagcaagctggggctgcaggtggtggagctgccggccgacgagagccttccggactgcgtcttcgtggaggacgtggccgtggtgtgcgaggagacggccctcatcacccgacccggggcgccgagccggaggaaggaggttgacatgatgaaagaagcattagaaaaacttcagctcaatatagtagagatgaaagatgaaaatgcaactttagatggcggagatgttttattcacaggcagagaattttttgtgggcctttccaaaaggacaaatcaacgaggtgctgaaatcttggctgatacttttaaggactatgcagtctccacagtgccagtggcagatgggttgcatttgaagagtttctgcagcatggctgggcctaacctgatcgcaattgggtctagtgaatctgcacagaaggcccttaagatcatgcaacagatgagtgaccaccgctacgacaaactcactgtgcctgatgacatagcagcaaactgtatatatctaaatatccccaacaaagggcacgtcttgctgcaccgaaccccggaagagtatccagaaagtgcaaaggtttatgagaaactgaaggaccatatgctgatccccgtgagcatgtctgaactggaaaaggtggatgggctgctcacctgctgctcagttttaattaacaagaaagtagactcctgagctgcagagtcccccccggtagccggcaagaccgcacaggcaaggccgatgactctgtgcccactcctgttgttttccttgacaatctactgtgccactgtgctactaactcttgtttacaaaatttgattctaagttgaattgcttcattcaacacccccaccctccctcccctcgaggtggtacctaagctgtggatttgctaaatgaattaagcaacctagaagatacagagctaatgaattatcaaaatgtgattaatcccagtaaggaaacactcatttagtgtctgtatttttggtgtgaaaattatttagttgccagtatattctgaagaatgtcttcttgatcagtcagataagcttgctttttttttttttttttttcatgaatcatgtttggttcctgtgaaagtccctggtccagggatcctcctcctttctcttttacttctgaattctgaaattcagttagttacttttgcctttcgctcttctatcacagccaccttgaccttgggtaaaacccaaggtctttccttctggctaccttcctgcaggtccaccctgtctgccattggtctcctctgcctctgactacatctgccaccaacaaccctcccctcacccctgccaggggcagacaggcttctcagcagaactgtgactgaaatcagagctgctgtctggggcagtgttaactacacagaggcacatcctgacagggtttgccccagagatctaaattccagaaggagggcaccacacctaggaaggtaaatccagtatcagaaggttgctaaaagattaaagatcaagaagcttggaaacatcccatgggtacaatgtcttagaaagtctttaagtcacataccatgaatttttgcttcattactgaccatatatgaccttggaggaactcttttttttttttccttctactcatttctgtttccacctaccctgactcaccgtatttccagtcttctacccctgcagttatcctagtccagcaaagtcatttctttcaaaagagacatcatgtctgaaaataattactggtagtctaatatgagccagagtaaacagctcctcatggtcaatgaacatgttcaggaagcgatcaccttgatgcttgaacccaaccccagacagtggacaattctactttgaaatatccgtgaatatttactgtgggatccaatttaaacttctttcttctctagcctttaaattacacaactttgaactgacacggatctcttacaaagaacaatgcggcactgaaggaagagatgattcctttactcaaacctgcaggaatcagcctattaacaggcaggggaaacggtactttccaatgaatggtaactgatccaggcacattatcacacttcctagtcatctccacctttcctgtattgcctgtggcttgttgtttaagattaagaatcaaagagattaagaagtatcacttcaagtcttgctctgctcacttctatgtttgcagtcaaattattccttatgttggtgacctaaagagaattactttcattcatttcatttcccccgtagcagatggaagtgagaaacctctgagaaaatgaaaacatccttaaccactatctttcccttttatttgattattttatgtcagaaatttgcaaaagtttttttctcctccttctcttccttgttgcttaactttttaattcatgccatatgcagatatccaattatgtgcatcctgtgaataaaccacgtcttggtcactgtcatattttgaaccatctcatcagagatgaataatatctttttaccagagagagaacgaatgttagccacatgcccaagttaacaaagaaaaaatgttctcaaggttgtccttttgggttaaatctggcccttccttggcaaaagcaaaaattctccctgtgagagctcaacatctcaaatacaaccacaggaaaaatggcccaatctgccagtttaggcttaccagcatataatttttaatatctttacttctatcatcccaaatcaaagaactcttctctattatgtttaatcaattgcaagcaaatagatttttctttgtaacaatttgttctgcagaaggctgtttttcacttttcctttcttttgcttctttctgtctttccttctcttttgtctggagaaatcacttagactctgtgtgcctcttctacattgcattctgctctgctatgttacctgctaggctggcttctttggactccctatatgattgatgatgtgaaaacctaaattacttgcagcatagtattacttctttgatgttctcattagcataatgttatttttgaaaaggaaagatactatcacataagttttcctcatctgttgtgatatacaccaatggataaactaacggaaactgctttttgacattaaaagacaggagaaattatatttaactaagtaaaagttaagtcagaattacttgggtgatgtgattcaatttagttaaaggatgatatagagaaaatacattatttagcattatttcttcagctataatgaattgctatagaaatcaggcagatctttctaatgtgtattgattggtcttttcagctactctgaacagattactaaggccatctcctcatctctaagggagaaaaatagtctgtagatgaataatgtaaggtaaagagttgcatgtcagtctttgtaattatttacactttaactttctccagaactcagacatgatttcaacatggtgttagatttgtgcattttattttcctgaccacctcattccagccaatgtatggttatccactctgtgtgccaaaaccaatcatgcctttcacggccctttagttcagagaagttctgcactgatttttagtctcttgatgtctcaatcttacatgtataccaatcacaatggaataaagtgttgagttgtactgtgaaaaaaaaaaaaaaaaaaaaaaaaaaaaa

SEQ ID NO: 2 - DNA, 60 bp, Homo sapiens
gatgtctcaatcttacatgtataccaatcacaatggaataaagtgttgagttgtactgtg

SEQ ID NO: 3 - DNA, 1255 bp, Homo sapiens
  misc_feature 16: n = A,T,C or G
  misc_feature 16: n = A,T,C or G
ggttttgtttcccctncctttcctatcgcgtgttctcaacagctcgctagtcacggtccggcattctcgggatatcctccagaagatcttgttagatgacactggtgttggcttatatatgtcagacgtatgagcgtttctcccatgttgccatgatcttgggtaagatggtcctgcagctatccaaagagccttctgcccgtctgctgaagcatgtagtgagatgttaccttcgactttcagataaccccaggtgctaaaagatgacaccaccacgaaacgctggcttgcacaactggtgaagaacctgcaagagggccaggtcaccgatccccggggtatccccctgccccctcagtgatccttccctgttccctcccactactcccccaagttggggaaaggagggggaacctacgagaaaaacagctcaggttttatcaccgactgggaatagacaacctcaatgctgaaccgcactggagaaaaggggcaaggtacccctgctgaggtgtatgggctgccatctcaggctgtcttgaggacctgggctccctctgctactcccaggaaatgggctcctgacacagcagtctgccaccacagccccaggagggtgtcaacaccagcaaatgctgtatttgcagcatgtccaagatgacccttctcccctacctctacctagccactggcagggaggggagacagtggtgatagcagcagcactctaggcatggtgaaacgcctggggacccaaccatgtggccgtttttttattttgcccttttcgggaagactccagatatggtctcttcctttctccctcagggttttggttaactttgggtttttttggtcttttaatcctcaaaaaagaaggtggggttttaatgggggccacaaagttgtaataattcccgcaaaaacctttgtgtcgacttgggaacttggtttacaaaagccctcgttaacgttgccattaagcctccaatttaaaaaagtttgcgtccttggggccattttaattccccacttctggggaaggccaaacaaaacctgggatttcaagcctgatcgggcgaaaaaaaaaggggcccgggaccactggtgaaaaaaaacagggacacagctcccaaaaagcataagtgcaggggggaacccgctcccacccggggggtgcccccctttccgcgtgcacacccagattcattaatcccccccaaatctacgacgaatgttccccgctgggtggacc

SEQ ID NO: 4 - DNA, 60 bp, Homo sapiens
tatccctttatgtttgcgaattatggaatctggaagtgaactttctaaaacagttgccac

SEQ ID NO: 5 - DNA, 2347 bp, Homo sapiens
gactcaacagagctatggcgggtttgactgtgagagacccagcggtggatcgttctctacgttctgtgttcgtggggaacattccttatgaagctactgaagagcagttgaaggacatcttttctgaggttggacctgttgttagtttcagattggtatacgatagagagacaggaaagccaaagggttatggcttctgtgaataccaagaccaagagggttagatgccagaggattagaggcccgtgcaatggaggcccagtctttgggtggaatgcatgtcaatggcgcacctcctctgatgcaagcttctatgcagggtggagttccagcaccagggcaaatgccagctgctgtcacaggacctggccctggttccttagctcctggaggaggaatgcaggctcaggttggaatgccaggaagtggaccagtgtccatggaacgggggcaaggaaccctacagcactcgcccgtgggacccgccgggcctgcatcaattgagcgagttcaagggcagagaacatggatgatatgggcatctgtccgaggctgtactccctccctactggtgtcatgaggcttggatggaatagcagtcttgccgatgcaagaccccagagcagctatgcagcggggatccttgcctgcgaatgtcccaacccctcgaggcttgttaggagatgctccgaatgatccacggggaggcactttactttctgtaactggagaggtagagcctagaggttacttgggaccacctcatcagggtccacccatgcaccatgtccctggccatgagagccgaggaccacccccacatgaactgaggggagggccattacccgagcccagacctctaatggcagaaccaagaggacccatgctagatcagaggggtccacccttggatggcagaggtggaagggatccccgaggaatagatgcacgagggatggaggcccgagccatggaggcaagagggttagatgccagaggattagaggcccagtgcctggccccagaggacctatacctagtggaatgcagggtcccagtccaattaacatgggggcggttgtcccccagggatccagacaggtcccagtcatgcagggaacaggaatgcaaggagcaagtatacagggtggaagccagcctggcggctttagtcccgggcagaaccaagtcactccacaggatcatgagaaggtaagcaacactgtctgactgcctccttatgcacaattctagcctttttgattcctcttttcacagttaccatgtgacgatcctgggtcttcaaagtccctttggaggtgatgtttattctaacttagaactcttttatgatcttgttacctgaaaatttgtgagtctggtcctgaagttcctaatggatgtgaagttcttaagtggatgtaaatggcggcttattttatatttcacactcatctgccaatagcaggtttttcttgttcaggccagattgacctgaaaatccacaccctttttccttccctttctactttatccctaaaaacaatagtagattccccatgattatatctttctgtttttatatttgaccattgtggggagcttatgtctgatggaaaggctaaaatttgtgaaaaagagagactttcaaaacaggattaaaacttgaaggatttccagggctcacagataccatcttagtctccaggaactttgagttcatgaagttgtctgttttgaatcgtctaatcttaggtattttaatttatacttgttcttttcattgtaccttttctcaccagttttttttttattttttattttttttggaggggggctgttggtttttttctgtgtgaaatgttcttcctttttccattttgcttcatatcccactacagtagctttttggacagaagctggtggtgggttttttgttttgttttgtattttttagctgccatcattaaaactcactaccttttttttttcctctgcacaggctgctttgattatgcaggttctacaactgactgcagaccagattgccatgttgcctcctgagcaaaggcagagtatcctgattttaaaggaacaaatacagaaatccactggagcaccttgataggttttcaaaaatacctggcaagaaatctggaaattctataattttgttgaaatattgaaaaaagatgacctgcatcctaacccttgaatgactcaaatcagtgccaggtggcggactcccatcaccttctctcagaacaaaatcacttcattttattgtcttagtttgtgtattttctgtgacttgaaataaactttgaacacaattttagtacactgc

SEQ ID NO: 6 - DNA, 60 bp, Homo sapiens
tccactggagcaccttgataggttttcaaaaatacctggcaagaaatctggaaattctat

SEQ ID NO: 7 - DNA, 1067 bp, Homo sapiens
gcgtctgccaggagctacggccggaagatggcggcggccgcagagttgtcgctactggagaagtccctgggactgagtaaggggaataaatacagtgctcagggcgagcgacagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttatagttgacctgacagttcaagaaaaggagaaatatcttaatgtgtctcgctggttttgtcacattcagcattatccaggcatcaggcaacatctgtctagtgttgtcttcatcaagaacagactatatactaattcccactagaagctgtccatgccatacagaagatctattaaaagtgttttaaatggaaaatgtactctagaccacaggactaatgtaaattaatatacagtcattcattatttgttgaagttgatagaatttttgaagtgtaaacttgtgtctgaatgttttatttgttctttagctgaagttttgcaatttttatgtcaaaattcaattgctattaaacaagttgagatccagttataaattaaccttgtttttagtagatgacatttatttcaataaaagttgcaaatcgggcttaatcttaaaattggtggtcatttcaatggttgacatatttggctatttattaacctctctttcatattctaaaattcattttccccttatggatatttatggtagtttgttaagaactgataaattgtgccaaggaagccaaaagggaagacagatggatttgttttaaaatgtttatgtgagctagtaaatgtgggaaaaaaaaaaaaaaaaaaaaaaaaaaaaaa

SEQ ID NO: 8 - DNA, 60 bp, Homo sapiens
ggcaacatctgtctagtgttgtcttcatcaagaacagactatatactaattcccactaga

SEQ ID NO: 9 - DNA, 2653 bp, Homo sapiens
tcggtgagcggtggtggtttattcttccgcggagttaagggctccgtggacatctcaggtcttcagggtcttccatctggtgagcctttggccccttggggcccgcggaagcttggccgctttcccattgggcgggggtcgtgaacgtcaagacagtcggtcccggcctgcagttgccgccgaggagccgtgggcacgatgactctgcaccgcctcctctgtgacggaccgacagccgggaatggcccccgccggccgccgtcgggggcttcccagtgccaagcctggacgccggggcccgcgagggggcgggctgagggtgggggtctgtgggcaggaccgagagttggggtggcttccgtcctcaggagttcggtacgtgaaagttagctctcccggaggtgccggtgaactcaaaatcgtgctgtgcccggcgtcaggcgtggagacaacagaaagttgtgcttaaagcccggcgagtgtctctgtgtcctccctgcttctctgctctgtgccatccttactttgcaccattcctattgcaattacctcaaccagttcgctgccctcggtctctcaccagccagagtgatcatttaaaatgccaatcagttcctgtgggccttgggaataatccagaggagccccattggctgagagataaaattctgtttttacctgggcacgcgggctctccaggatttgattccagcttacctttccagtcttgattccctatattccagtatttggaaatgtgggcattggactgaggctttaccaaataacgctgagcacctagtattgccttttgcacgaatggtactgatggtgcccaagataactgcctccacccccaagttcaggacccagatcactctctggagaaggcctcagcctcttgccttggctttcaaggctctgcgtgatttggatactcacttagctcttatttatatatattttaaaagcatcagcagtttatctcatgcccactaaactatcctgcctcggtaccctttgttcatactttctgctctgtgtggaatgcccttctttcttcccctgttctttctcttagacccaagggttctcagccttatttctgcctctcccatctctgatttactttcattttctgtatcgatttctcaaaaaatactttcttgattctttcatcatcccttttcccaccctacccccggttcctctttccacattataatctatgactgcctctctcacctaactgccagtattagcttttcaggacaggaactggttttacacattttggtattccagcatctagcataatgcctgacacttagctgaataaagggagtaaataaaacagatttgtaaagtcagcaaatgctttttaatttgtgaatcttattttaatgatgatctgattttctttttacaggaactatataaagttcagaaaacatggtgagttaatacacatgccaataaacggttgcctgataaacagtattgcttgtactcagtttacagacttgagtgggaaaattgaaatagaaggaaagcagtgagaaggtgccttttttcttgtcagtttcctctcacctattgaactttgtataccaggataggttttgtaagatcatttgtaggcttgcaggagttggcctactttcagtgggtaggaatcactcatgtgtttttcctttgcagtctcgaagatatgactccaggaccactatattttctccagaagggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 10 - DNA, 60 bp, Homo sapiens
tcagcacttgctttagctatcaaagtactaaataagaccatggatgttagtaaactctct

SEQ ID NO: 11 - DNA, 1236 bp, Homo sapiens
aattcccgggatggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggctattggggctgtggcatccggcaaagccagggcaagctgccaagaccgaaaatagagaagcttccgatgaaaggaatggacctggccgtgatatcctttaagcaacctgcaagaagcccttcctctcgcacctgacccaaacggtcaggattaaagctctttggaggttcgaactcagccggggttgccgccgtgtacctacgtgcccggcgcgcggcaaccggtgccccccacatgatgaagaagaagacggcacagcacccgctgcgctccgcgaaggcgtcggaacggcgaagaagcagggaatctccccggactcgactaatgttgcggcgcttttaccctccccagtatgccccctcgtgcccccctcgcaattctgtctgttggccgacgcactatgggcccccctgtcggtggcggcaaggcgacgggcggaccttacgcggcccgagacgcgaccgcccgccaactcgtccggctcgtgtagagcgacgcgcctgaccggccggcggggctctgggtctatctccgccccccttccgcgaccgaacaggtcaggtaggcggccggcgcgcgtaggtgacacaggcgtcagtatagagcgtccgtctggccgcgatcgacaacgccgccggggcccccatccatcccctcgccgcgtcgacgcgatgagatatggagcgtcaggcggggcgcgcggcggatcag

SEQ ID NO: 12 - DNA, 60 bp, Homo sapiens
ccagcatctattgtattttaaatttctactccagtccaatgtaactatttagccctggat

SEQ ID NO: 13 - DNA, 1542 bp, Homo sapiens
tgcgtttagggcgaagacggagttgtaaacttcttaaaattcctctctcgacacttcggtaattcctctttcgagactaaagctctttttgtatgcgtgtgtgtcaagcgtatgccccgggattctcctccgcttccttttctcggtcttccttcttgctttagggaccggaagagtccttgaaccaaaatagctcggcgggcacttccggggccggcgcccagagttccgggagggtgcaggcaggagagggaaaggcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaacctatcaattccctcgggggcagtgtctttcctaagcttaattggagtgccccaagggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcaggattccccagctttccgttgcacaaacagtgaagtgacagtccagcccagcccctatttgagttaccggctacccaaggactttgtagacctctctactgggagggacgctcacaagctaatagacttccttaagctgaagagaaatcagcaggaggacgactgatgagcgtactgtaactggagaagaggaggccccgccccaccgctccgggagctgctcatcagccgcaacttcctgccgaccctgatgcgggtgggccgagcagtgtggacatcagccactttttatattcatgtacattcacctggggaaaaaaacggagggactttgctacttgtaaaaataacataataaatagatcttaaacataggaaaaccatactgttctgataataaaatgctttctatgaaat

SEQ ID NO: 14 - DNA, 4327 bp, Homo sapiens
gcaggcgcagccgtgcgatgttgtcctctacagccatgtattcggctcctggcagagacttggggatggaaccgcacagagccgcgggccctttgcagctgcgattttcgccctacgttttcaacggaggtactatactggcaattgctggagaagattttgcaattgttgcttctgatactcgattgagtgaagggttttcaattcatacgcgggatagccccaaatgttacaaattaacagacaaaacagtcattggatgcagcggttttcatggagactgtcttacgctgacaaagattattgaagcaagactaaagatgtataagcattccaataataaggccatgactacgggggcaattgctgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaacctggatttatctggaaactctctttccatttgtgtataaatgaatctcactggctgccacagctatttcttggaggaataaaagcaaacgcttggacactgaggagtggattggacacagcaacgcgaccctcgccaaatgctgttgcctggatcttggactccctggcctccgtaatgagatgaggtttcaccgtgttgcccgggctggtctcgaactcctgagtttaggcaatgcccccgccttggcctcccaaggtgctgggattgcaggaatgctgggaaacgaggagaaacactatgcttttcacagcatcacagacggtactggacccttcctatcaatgggaccatttcagggctgccacttggccagggcatcgcagtgggctgttggatcagaccgagaggcaccaattcaaacgcccccggcaagaacctatgtcaggtggatgggatgcttataaacggcagagctatgcctgctatcaaggattagaatgaaaatatctgagcagcctcagcagacagtagctggtggcacctcaggagaccggaaaagccctacctgccaggacccctagacccagcccttgcctgtcttgaaacagcaaagggagtgatcttggggacaccagaacagtctgcttgcagagattaggaacaggacagcttattccagtcaaacagcgagactaaaagtgagtctaaggctccagcctctccagattcctcctggcccacgcatgaacatggtctccgtggccatcgattcttctgagcccacctcctccacgtgagtacacacgcttgtctacctatggtctgtgaaagtgcacagactttgggtcaaacagatttgagtgtagagtctggcttagaattccagacccagctcttcttcactgtgtgatttggggcaaaataacctggcctctggaagcctgagtttttcatctgtaaaatgaaagcagcactatttttcactacgatgtgccagcacaccacccatctagaccctaaacaaggtggaccccagctggctccctggtgaccagctccaaaatgccttcctttggacttcacgttctgtgagagaacgcaaaccctgacatctggtttcatccagttccttagcttttcagtgacaggcagctgaactcaattgttaattgactgatctccattgcatagggttactgtgaagcgcatatgagatcacagatgttaaagtgccaaaccacgtgacttatttaggactcctgactttcctaatgttgcatggaggatatttaatcataaaacagttaaatctggcatagtgggctaccaagaagaaggcagggttccgcttaccatactgagagagggattgaggcagaaactccctggaactatgggcagcaacaaaggagggagggcaggtcacctgtgcagaagaacatgcacacacacaggcatgcacacatatttgtacacgggcacactcatctgcacacacacatgcacgcatacgtgcacaccctccagcacacatgtgttcagatcatgctctcatttacacgtgcacacgggcatgcacactcatgcacatgtactgttgactctatcttgagcttacacatcaaagccacgatctggttcagtacttacttgtttattgatattccatttagcatttaccaagtaccttctatgtaacttggctaggcagtctttttttctcaaacaaaatccagtacaaatcctccctcatccatgaaatctttctggattctccaatgggattgaactaatcctcatagaactttccatgtgcccctgcttgtcacgaatttcatttaccttcagagtaaaattgttgcacatacttctgtttccttaagacttgggagctgacattctaggccccagtgaaaaggtctggtcctgaaactgcgtctcagttcttggcttgagaaaagcacagctggttagaagtgcttacaccacggaggcatgaagaggacgtgagggtggctcattttaaaagcaatgcgtttatcttatcttccagtgcagagagagagagaatcccctgcttagagcacagaagctggtgcaccgtcctgtgccgcattgtcctctggctgcctgcctggggagacccctctcccctctccttcctgaacgcaggcacgaggatttgtacatacgtgcacataaatatggtatttcccagagggcctggcataaacattcttaatatgtgcttgttatattgcagtgaactaacacccacagtcagtcaggaaacaaagtgcattgcatgttacctggggaacagtcagcagaaccttgattttacctggagagtctggggctgcacttttggcacgtgggagttcccacagctaccagtccaggaatcccagggtgactgccattttccaagggttacatcccccaaatatgtcacaaaacatgtttaaacaaataccttggcttctgcttttttatctatacaacagttctcaacatggccacagattagaatcaatcctgatgcctttttagagtgtacattaccagagcccccaggctgaccgagccagaaccatgcctggggccatagcacgtcagtggtctcagggcacacgggagattccgtggcacccttaggccatagcacgtcagtggtctcggggcacacgggagattctgtgggcccccgaggccatagcacgtcagtggtctcggagcacacgggagattctgtggcaccctgaggccatagcacgtcagtggtctcagagcgcatgggagattccgggccccctgaggccgtagcacgtcagtggtctcggggcgcacgggagattccatggccccctggggccatagcacgtcggtggtctcggagcacacgggagattccgtgtcaccgtgaggccatgcacgtcagtggtctcggagcacgcgggagattctgtgggcccccgaggccatagcacgtcagtggtctcggagcacacgggagattccgtggcaccctgaggccatagcacatcagtggtctcggagcacacgggagattccgggccccctgaggccgtagcacgtcagtggtctcggagcacacgggagattccgtggcaccctgaggccatagcacgtcagtggtctcagagcacacgggagattccgtgggccccctgaggccatagcacgtcagtggtctcagagcacacgggagattccgtgggccccctgaggccagagcacgtcagtggtctcggagcacacgggagattccgtggccccctgaggccagagcacgtcagtggtctcagagcacacgggagattccgtggccccctggggccatagcacgtcagcggtctcggagcacacgggagattctgtggccccctggctagaacactggaccagatggtctgcaggttctcctctgagtctgatggtcttgtctatgttaaaatgtctcggccgggcgcggtggctcacgcctgtaatcccagcactttgggaggccgaggcgggtggatcatgaggtcaggagatcgagaccatcctggctaacaaggtgaaaccctgtctctactaaaaatacaaaaattagccaggcgcggtggcgggcgcctgtagtcccagctactcgggaagctgaggcaggagaatggcgtgaacctgggaagcagagcttgcagtgagccgagattgcgccactgcagtccgcagtccggcctgggcgacagagcgagactccgtctc

SEQ ID NO: 15 - DNA, 60 bp, Homo sapiens
gccttgtacattaaaatatacacacgcaatttgaacgaaccgatggttcttaaaacagaa

SEQ ID NO: 16 - DNA, 2178 bp, Homo sapiens
tccgcgcgggcccgggttggccaccgccgggcccccgcccctcccccggcggtgtcccggccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctg

SEQ ID NO: 17 - DNA, 60 bp, Homo sapiens
agtattaatgtgtagatagcactctggtagctgttaactgcaagtttagcttgaattaag

SEQ ID NO: 18 - DNA, 1480 bp, Homo sapiens
gggagggaagatgaggttgaagagattaaaaaaccgggtgcgcctgcgcgttgcagattagttgaaaacgctcagggtttgtgaggggcggggtcacgtatgcgcgtcattggacgggtcggtgggagggagggtggagatgggtagggtgtgtgcgcttgcgcagtgcgggggtggagggcggaggagatagatagcacgcttgcgcggctgtcatagggctgcttggttggtcagtggggagtcggcgcctgcgtactaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatca

SEQ ID NO: 19 - DNA, 60 bp, Homo sapiens
aggtccatctggttggtattgacatctttactgggaagaaatatgaagatatctgcccgt

SEQ ID NO: 20 - DNA, 1452 bp, Homo sapiens
ggctggagggccgggcaccgcggccatggagggtcaacgctggctgccgctggaggccaatcccgaggtcaccaaccagtttcttaaacaattaggtctacatcctaactggcaattcgttgatgtatatggaatggatcctgaactccttagcatggtaccaagaccagtctgtgcagtcttacttctctttcctattacagaaacagtatgaagtattcagaacagaagaggaagaaaaaataaaatctcagggacaagatgttacatcatcagtatatttcatgaagcaaacaatcagcaatgcctgtggaaccaattggactgattcatggctattgcaaacaataaagacaagatgcacttgaatctggatcaaccttgaaaaaattcctggaggaatctggtgtcaatgagccctgaagaacgagccagatacctggagaactatgatgccatccgagttactcatgagaccagtgccatgaaaggtcagacctgaggcaccacgtatagatgagacagtagatcttcatttaatgcatagtcatgtggatggggcatctctatgaattagatggcggagccattccaattaccatggtgaaaccttcgggtgaacttttagaggagcgcagaattggcgcagtttgggggaccgtgacaaataaggggaaggcgtcgggcccgtgtatgggcgcacgcttgttgaactctccccgcacccaaattggttccgcggtttgggttgaaaaaaaatcgtgcggtcgtggctgtgctgtggctcaatctactagctacgtgtccttctcacgcacacacaactagcagaacaaacacaagacgacacaacagcaaaccactgacacagccacaactatgaccgactagcattacagcctacagcacacaaccagctagcaagtagctacactactgacagagtacgatagaagctacacagacggacatagaaagccgcacggacaggcaagcactcagagcacaaagcccacgactcgagacgagaagaagccagcaggtcaaggagcagaggagacgagaagacgcgaagagacgaacaaccggcagcacggaggagaagatacaggcagcagggagcacagagcgagaaagaacagaaagcacggaatgaagggggcagcagagagagagaggggacacgtgacgagacgactgcaagtcggcaggtaggggagagtgagagcagagcaggacgcgagaccagtacggagcggcaacagacgcgagcagagacacccgggcgggccagcggggcacgagcgaacgggcgcacagagagagcagggagacgagaaggcacacgcagcaccgcgcggcccggagacggaccgacgccgacaacaggaaaacgagagcccgagagaacggggcggcgcaaacacgacacgggcaggtggagacgagaag

SEQ ID NO: 21 - DNA, 60 bp, Homo sapiens
cctgtggaacaattggactgattcatgctattgcaaacaataaagacaagatgcactttg

SEQ ID NO: 22 - DNA, 3547 bp, Homo sapiens
cacaactacatacctttgctgttacagcatgaaagcagccatagacaatatataaatgagtgagtgtggcagtgtcctaatgaaaccttatgtacaaaaacagtggttgttgtcttaacagtggggttttactgttttgacgttttaactcataaatacagtttgctgtatggaacatgttaagattttacagtgtcaaatccatttagaatgacctttccagaaacttagctgtatttattgttttagaacaggagttggcagcctttcagaaatgatttgccaaaattatggcctctgtccttctagcattacattttgggtacaggaaatttgatacacaagttgacttttttctacttctaataggacctgagggccttgaaaatatcttttcccaaaactggttttgttatattgtcagaagaatctcactttgtcacataaccagaaatcctaagattcaaatgattcctaatcatcttttataaaaattgaaatgtccttgggaatgttaaaggaatgagattgaatatttataccttcaactgaattacctgaaacagattgcagcccccattataccaggctgaaatcagcacacaaggggatgatactgacacaaagggaaccatgccaaaaagtgctttgaaggttttatggttgttttgaagggaatggggtgaggaaagtagggggaagggagtcctgagaagaatatagatgaaagagggctctctttgattagccagagggcaacataagatttggagaccatgggaaaggagctctggggtgccttcctgcttctcctgtgagttaagctttgacttcttataaatgttgtttcacacctcttctggacaggctcctaattaatgggagacaagagagcaaggtagttgtgtcattgatgctcacaagtagtgagaagttaaaaaaaaaaaaattaattgtcattaaaaattggtcacctgccttcttttgcaaaatttttaacagatgccaacccctgttctggaggttccttaataccagaattcaagattccaaatttttagatgttacttacctcgatccttcggtttcaaagagaatcgcttattttaaaattaacatttaaacattatatatcgcttaaataactgaattacataaccagtttatttcttatttcatttgcaggtaaaagtagtttttctttcttgtttttatccattcttgcagctttaacagttacatatcaataggtctatatagttgtgactccagacttatgactataactatagctgtatctcattttgaaatcttattttgtttacttcagcatacctcatctcagaactagaagctgccagaatgctctgtgtgaatgctcctccaaaaaaagctcaagaaggaggcggtagtgaggtctttcaagagttgaaaggcatatgtattgctctaggaatgtccaaacctccagccaatataactatgttccaattcttcagcgggattgaaaaaaaattaaaggaaacattagcaaaagttccacctaatcatgtgggaaagcctttactgaagaagccaatgggaccagcccactggagccagacagaaaaattagccaaggtttaccagccgaaacgttcagtcttatcccctaaaactactatttctgttgcccatcttttggctgcaaggcaggacttgtcaaagattttaaggacaagcagcggctctataagagaaaagactgcctgtgccatcaataaggtgttgatgggcagggtgcctgacagaggtggtagacccaatgaaatcgaacctccacccccagagatgccaccgtggcagaagaggcaagatggcccccagcagcaaacaggaggccgaggaggagggagaggtggctatgaacattcctcatacggaggacgaggaggtcatgaacaaggaggcgggagaggtggacgtggtggctatgaccatggtggccgagggggaggaagaggaaataagcatcaaggaggctggacagatggagggagtggtggaggaggtggctaccaagatggtggttatcgagattcaggtttccagccaggtggctatcatggtggccacagcagtggtggctatcaaggcggaggttatggtggcttccaaacatcttcttcatatacaggaagtggataccagggtggtggctaccagcaggacaatagataccaagatggcgggcaccatggtgatcgtggtggtggtcgtggtgggcgaggtggtcgtggaggccgaggtggtcgtgcaggccagggaggaggctggggaggaagagggagccagaattatcaccaagggggtcaatttgaacagcatttccagcatggaggttatcagtataatcattctggatttggacagggaagacattacactagttgaggctaccgaaccttacattttgctagagctcaagtaatagaaacttagtttcagaatcctgaattcagcacctattttgaattaatgtgagaccacaggtggcaggcagattcctgcttggcataagcatttgtaggtcttcattcaattctgttagatttttttattggacttacataatgccgtttatttgagaaacacataacatctctcctttctatgaaaaattttttaaaaggtggttaaaattgcctttaattgcccagtagactaattccacagtcagaacatgcaaacttttttgaagaaattacttgaataagtagttttcatgttttcaatatgcagttttgaaaatgaggattcacctagacttttttagatttactactaggaaaccttcctcatatgaataaccatttatatgtgttttgcttaaagtattccaatgcctattttccaagcacagttctgccccccggttgacttttatgccacgtgtgcttcatgatggaacttttaggtcagttcctattaaatgagctcttctgcagatagcacattcagtagccttattttgttgatggaatactgtatcatatgctcaactctgaaaaccttgaacacggccaaaatccataaagattataaaagcaaactaagttgtgaagctatagtacatgtaggcatttagttaagtatagcaattcaaactgacctgcatccatccaaaacaaattcctccttcaaccttatttttacttgaaatttgctagaagaaatagcaaaccgaaatttgttttatgcatgagttaataccactggctcagcaaatacaagttagtttgctttaagcaggtaactttttttgtaatggaagaaatgcactacaaagttaagacagatttttgctaagtgcaggaggccctttattattgctgcagaaaacaaaagcctggctgagttgatgttttacattctcccttactgaaatctacatgacatgatgcttcttgctgggtttttgtacatgtaaacattgtcaagctgtgaaagaaaatggctggaggtgtgctttgtgtgaaaggtgagcaataaagtatctgttaagttc

SEQ ID NO: 23 - DNA, 60 bp, Homo sapiens
agttgtgaagctatagtacatgtaggcatttagttaagtatagcaattcaaactgacctg

SEQ ID NO: 24 - DNA, 1189 bp, Homo sapiens
gggagaacagcggtcgcgccggcaagagcagcgggagcggcgcggggaagggggcggtgtccgcagagcaggtgattgctggcttcaacctgccttcggccaggaacagcgaggcctggccatccaaagcagctgagttggagatggagttgaatgagcacagcctagtgatcgactacactgacaggaggtagatgcacaactcgtaagtgctaccgcatggttggcggagtgctggtggcacgcgacactgtcaaacgaggtgctgcccgcctttggagaacaacaaggagcagatacacgacgatcattgagacactgacacagcagcttcaggcaaagggacacacagaactaacatgcacttccgggaaaagcacaacacttcgtctcatggcgcaccacagactgagaagccacgcacgccaaggcacacactcacgacgcgcgcgctgggcgctaccggccacgcctcacgctggagtgctcgagcctcactaggcgacccaaacggccttttgccactttcccctcttaacccctgacatcccactttctacactttctcattaactcggctcatctataacattataatacctcctgcctattggtacaatactacccaccgggcacacacccaccaccgctccccgcgcccccgcaccatcctgacacaacaacacaccacacaacacacaccaccccccacggcacccccccaccacacgccgcggccaccaaacacaccaacaccagcgacacccgccacactgcgagaccacaaatgtggcagtcgcaaaaatagactcggaataccatcgggcgacacaccacggccgacatccgtacggggcgccccgcatcgcggcgccggcacagactcactaccccacagcgagcatcgaacacaataaacgacgcgggagggactgacgagcaactcagactcaccacccgaccacaagaagccgggtgtgttgaacacgcgcggggccattacaggcgagctcgctggcgccgacgcgccacgcggagcgcccagtgaggcgactcaccgatgctccagggccagcagcacgacgacggtgctgcgccaacacatgactgcgcacgacagcgtgcagcgcccccaccagacggaggcgagcaaccagcagagtcagctgccacaccggaagcgcccccc

SEQ ID NO: 25 - DNA, 60 bp, Homo sapiens
agcttcaggcaaagggaaaagaactaaatgaattccgggaaaagcacaacattcgtctca

SEQ ID NO: 26 - DNA, 5554 bp, Homo sapiens
tgttcagttaccacgtgaaccgccgacggagacccgtagtgggggaggcggcggcagcgttaagtgagaaaggaaaaaagacaacgaggaaaaaggaggtgtccgggtagggcaacgcggcgacacccgaggcctggtggtggcggcggatcgagatattcaaggctgaagcagctacggaacggcagcggcggcggtcggacaaactgactgaccgagccgggtggtggcgggagcagcgggagcagccggaacgatgccggccgtgagcctcccgcccaaggagaatgcgctcttcaagcggatcttgaggtgttatgaacataaacagtatagaaatggattgaaattctgtaaacaaatactttctaatcccaaatttgcagagcatggagaaaccttggctatgaaaggattaacattgaactgtttggggaaaaaggaagaagcttatgaattggttcgtagaggtttgagaaatgacttgaagagtcatgtgtgttggcacgtttatggccttcttcagaggtcagacaagaagtatgatgaagccattaagtgttacagaaatgcactaaaatgggataaagacaatcttcaaatcttaagggacctttccttactacagattcaaatgcgagatcttgagggttacagggaaacgaggtatcagttacttcagcttcgacctgcgcagagagcatcatggattggttatgctattgcttaccatttattagaagattatgaaatggcagcaaagattttagaagaatttaggaaaacacaacagacatcccctgacaaggtggattatgaatatagtgaactactcttatatcagaatcaagttcttcgggaagcaggtctctatagagaagctttggaacatctttgtacctatgaaaagcagatttgtgataaacttgctgtagaagaaaccaaaggggaacttctgttgcaactatgtcgtttggaagatgctgcagatgtttatagaggattgcaagagagaaatcctgaaaactgggcctattacaaaggcttggaaaaagcactcaagccagctaatatgttagaacggctaaaaatttatgaggaagcctggactaaatatcccaggggactggtgccaagaaggctgccgttaaactttttatctggtgagaagtttaaagaatgtttggataagttcctaaggatgaatttcagcaagggttgcccaccagtcttcaatactttaagatcattatacaaagacaaagaaaaggtggcaatcatagaagagttagtagtaggttatgaaacctctctaaaaagctgccggttatttaaccccaatgatgatggaaaggaggaaccaccaaccacattactttgggtccagtactacttggcacaacattatgacaaaattggtcagccatctattgctttggagtacataaatactgctattgaaagtacacctacattaatagaactctttctcgtgaaagctaaaatctataagcatgctggaaatattaaagaagctgcaaggtggatggatgaggcccaggccttggacacagcagacagatttatcaactccaaatgtgcaaaatacatgctaaaagccaacctgattaaagaagctgaagaaatgtgctcaaagtttacaagggaaggaacatcagcggtagagaatttgaatgaaatgcagtgcatgtggttccaaacagaatgtgcccaggcttataaagcaatgaataaatttggtgaagcacttaagaaatgtcatgagattgagagacattttatagaaatcactgatgaccagtttgactttcatacatactgtatgaggaagattacccttagatcatatgtggacttattaaaactagaagatgtacttcgacagcatccattttacttcaaggcagcaagaattgctatagagatctatttgaagcttcatgacaacccccttacagatgagaataaagaacacgaagctgatacagcaaacatgtctgacaaagagctaaagaagctacgtaataaacaaagaagagctcaaaagaaagcccagatagaagaagagaaaaaaaatgcagaaaaagaaaagcagcagagaaatcagaaaaagaagaaggatgatgatgatgaggagataggaggtccaaaagaagaacttattccagagaaactggccaaggttgaaactccattggaagaagctattaaatttttaacaccgttgaagaacttggtgaagaacaagatagagactcatctttttgcctttgagatttactttaggaaagaaaagtttcttttgatgctacaatcagtaaagagggcatttgctattgattctagtcatccctggcttcatgagtgtatgattcgtctctttaatactgcagtgtgtgaaagtaaagatttatctgatacagttagaacagtattaaaacaagaaatgaatcgtctttttggagcaacgaatccaaagaattttaatgaaacttttctgaaaaggaattctgattcattgccacacagattatcagctgccaaaatggtatattacttagatccttctagtcagaagcgagctatagagttggcaacaacacttgatgaatctctcactaacagaaacctccagacatgtatggaggtattggaagccttgtatgatggtagcctaggagactgtaaagaagctgctgaaatttatagagcaaattgtcataagcttttcccttatgctttggctttcatgcctcctggatatgaagaggatatgaagatcacagttaatggagatagttctgcagaagctgaagaactggccaatgaaatttgaacatcactaaacaagcaaatggaatgactttggaccatatctagtatataatatttttgtcacgcacctgctgcattgctctaacttacacagaatgagaggagtaaatgttcttgccttcaaatagtgttttacgttttttatcctgctgaaaaagtatatataaaatatctaacattacaggatagaggttcagtttcttaaaaaattaaagctgctaaaattgagtggttaaaaaagataccttatcctattcctccccacccacccatgtttttaaactaatttatataaaatctggaggctgttacagctaacaaagcaggtgtgtggcagaaatattactttaaatttgtcttgtgagattttactatatctcagacagcataaatgctgttttagcactggattctttcactgagcacaaagagttgttggggctttagcatctgactgattttgttacggggttgattctgaccataggaagtatgcaatgtgaatcactatttacagagaaacctacaacagatgcttgatgttgtagaaactgggacatatagataccaagcaaaattataagaaacctataaggtgttcaatacgcttgtgtttccaaaattcactgtacatgatcagtttggtgttcttgtaccacagtttttaactgaaggaaccagttgtaacagtctcaattttaactaaaacttgaagaactaaaacaacaatgcaaacctttcagcattgtttggccaaacttgttaaaactgtaatgcaagaaccaaatgcactgtgatgtggcaccaactaattagcaagcatgaatttttcacccaagagtgaaaaaaggaaaatctaccatggcttgaagttaaagagcagaactcctgactaccattctatgactgatcaaaagactaatagttaaaaacctcagcaggccttgttcacgatatgcagaaaaaaaagtgctgcagtttagatacctctggaatttttccacagtgtcacaggtttgtaatacttgaagccctacatttctaagaatatatttcttgctcagttgtttcaggcaagcccaagactttgtaatttttaaagggcccaagattttttttttttttttttttttcaaataacagaccagcttctttttcttgcagttacagatgtaatttcctttttgttgtcaaacataaggtaccaaatatgatgcaataaattgttttgaaaaacagttgtgtgaatatttcaactaatctgtgttgggcttctgtgaaatacacaggtggaaacagaggtgcaagccagaggcaatgtaatatgctgtaaggctagtgcagatgggagctttttagaaggggctaagtgctggtgtcagggaaattccataatgaagtagaatgctgctcctgcattaagatttcattgagggcaaggctggtggcaggtactatgaatgtaattcataatttaaaaggaaaactaaaaactattttgatttgggaaaatgagccttaatttgttaaacctatacactgagaactagcctcaggcttaatattctcattgcatttgcaagatctgagcaaataagattaagtaaaacaaatcaattgtatatataattgacctttttgtggaacatgtagtttatagaaagtatactctaaagggaatttgccgaagaccttttactgattgaacagttgtgctacaatcaacttttcatagtacatgacctgcattccacatctcagtctaacagtttagtagtgatgtaaagagaagtacaaaccgaactccagtgctttgttatgttttattaactggccctgtctcaggaacatcttaacagatggcaaaaaaacaaaaactttttttcaactcctatgagtggcaactgaagttcttattgttgggaaagaacactagtcctacctctgccactaatgaggtgtttggaggaggtaccagccatataatagggggtgtatgtgtgaattttgtttaaactctactgtatattgaaatgaaattcatttatttgtcttgacaatgttcaaatgatgtagattgtcttagaatgaatattcataagtactcagaactcttaagatgcagatgccacccgtgaggagctaaattcctaatgtgtattgtattccaacccaattttactggaactattgaataaatcttttattttctttcaggtttacttgatagtggatacattggtgtcagaggaccttgactgggttcattttatgtccagacatcacccctgaaacactgtactgtactatcttgctctgagtagtatcaactggatcgtctcatatttgcctcattcatcctattaatttcaaatgatactgtgggggaaaaacagggttagaaaaacaagtggaaaaaatggagtgatgttgtaatctaaacaagtgccttatgtttattgctaagaactggtgttaccaacccttttgagaagaaagggtctcttgacctgtattaacataggaaagtaaagttctttttgtttttctttatattcagctactcttgtcatttctcgttgaaaaactaaaatctgactaggttagtttactcagctttaattagatagttgagtcatatattttcaacatttttctgtatcgtatttattatgcacaaaaataaagtgtgatctct

SEQ ID NO: 27 - DNA, 60 bp, Homo sapiens
agtgatgttgtaatctaaacaagtgccttatgtttattgctaagaactggtgttaccaac

SEQ ID NO: 28 - DNA, 1220 bp, Homo sapiens
aaacggtgtttggtggagcccgcgatggccgaacctgcgtctgtcgcggctgaatctctcgcgggcagcagggcgcgcgctgcacgcacagtactaggtcaggtggtgctcccgggtgaggagctgctcctgccggaacaggaggacgcggaaggccctgggggtgcagtggagcgaccgttgagcctgaatgctagagcgtgctcgcgggtgcgcgttgtatgcggtccgggccttcggcgctgtggggaccgcctgctggtcaccaagtgcggccgcctccgtcacaaggagcccggcagtggcagcggcggcggtgtttactgggtggactctcagcagaagcggtatgttccagtaaaaggagaccatgtgattggcatagtgacagctaaatctggagatatattcaaagttgatgttggagggagtgagccagcttctttgtcttacttgtcatttgaaggtgcaactaaaagaaacagaccaaatgtgcaggttggagatctcatctatggccagtttgtggttgctaataaagacatggaaccagagatggtctgtattgacagctgtggacgagccaatggaatgggtgtcattggacaggatggtctgctttttaaagtgactctgggcttaattagaaagctattagctccagattgtgaaatcatacaggaagtgggaaaactctatccactggagatagtatttggaatgaatggaagaatatgggttaaggcaaaaaccatccagcagactttaattttggcaaacattttagaagcttgtgaacacatgacgtcagatcaaagaaaacagatcttctccagattggcagaaagttgatataggtggacttttttacaggtcagttgaggcaaaaaactatgggttttttcaggtgaacctcccccatttaaatactcagaagataaggtgtgaatgtatgtattattagagtccgaaagtatttttataagttactggttttcacccacgcttttgtgggagagaaaatcattgcaaaatcattttttttgttcggtacaataaagtttactaaaaaacagtattagggtttatttggagttaactcccttagtaattgctacagcttccataattaactggaggtcagcagtaaaataattttgtgattataacagtaagccaggttcaccagaggaaatgtggaatacctaagtataaagcag

SEQ ID NO: 29 - DNA, 60 bp, Homo sapiens
agtatttttataagttactggttttcacccacgcttttgtgggagagaaaatcattgcaa

SEQ ID NO: 30 - DNA, 2450 bp, Homo sapiens
ctgaataaactcttaaaaagcagacacactttacttgtgtaaacactcttcttttttttttttttaaatggaatttctctcttgttgcccaggctggtgtgcaatggtgtgatcttggctcaccgcaacctccacctcccgggttcaagcgattctcctgcctcagcctcccgagtagctgggattccaggcatgtgccaccatgcccggctaatttcgtatttctaatagagatggggttcctccatgttggtcaggctggtcacgaactcccaatctcaggtgatctgcctgcctcggcctcccaaagtgctgggattacaggcccagccgtatccactcttttaaatttaggcatccatgtcactggaattatgtttttcacaggatcacttttaaattcattaagaagtttctttatgtatataagcctattcattttacttgaaaggttttctgtcttcccaaagtcaaatccttactaactaaaattaggaattttgaaaaaccatccatgaaaatctcacaaacacattaaaaaatgtattatctaaggtgcataaaattaaactccatattaccaatagcatttaagaaactcatataaaatgataatgttttctttaaagagacatactgaaagccaagtcagttgttcacaggaggtggttttgcaccattatctgaactttgatgtgtgaatttgctttagaagtccatggtctgtttactctctgacagattctgttttcacatgcccctcacatgaaggttcactcctcattcttttttttttttttttgagacaggttgggtgggactgcttcaggattctaaaagacagtaccttctggtgcactttctaagatggaacataattctactctttgaaaatcattagagagtatatattaatgaactttggcttctatgaactttctgggcatgcctgtttgattggtgcagagtccttggttgtaacagaaacatcaaatagggaaaacgatttccttatggttgattgacttacatcagtataaaattgatgaggaatttatatacacgttgtatactgctgttaatgtttggtacagtgctttctttagtgttttcattttgaggggttattagattcagcattttctggagcagaatgctttttaaaggggatttggtctttttgggaaataatttataaaggttaatttggaaaaagctgaatttaaatacgtgtagctcttataattatgagctttttacatttacactgacgttcttttgtataggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcag

SEQ ID NO: 31 - DNA, 60 bp, Homo sapiens
agttcttttaggattataggttgcaaattatccaaatatatatcccattttttaaagcat

SEQ ID NO: 32 - DNA, 2513 bp, Homo sapiens
cccggtagtcccacgtgtagcggagaaacagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgtacgagctggagcgagtcgctggatttgtccgcgacctggggtgtgaacgagttgccttgcagttccctgaccagctattgggagatgctgtggctgtggctgcacgactggaggagacgacagggtcaaagatgttcattctgggtgacacagcctacggcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctggaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagcgttggtctatactgactcttatttctcagggagatcacagcaacctaaataaaccagataccttttctcaaaaaaaaaaaaaaaa

SEQ ID NO: 33 - DNA, 60 bp, Homo sapiens
tatactgactcttatttctcagggagatcacagcaacctaaataaaccagataccttttc

SEQ ID NO: 34 - DNA, 2840 bp, Homo sapiens
ggtggggttgcgctcacaaggggcgaccgtcgccacggtggcggccactgcatcgcgtcccacctccgcggccctgggcgccgtggtgtcgacgggccccgagcctatgacgggccagggccagtcggcgtccgggtcgtcggcgtggagcacggtattccgccacgtccggtatgagaacctgatagcgggcgtgagcggcggcgtcttatccaaccttgcgctgcatccgctcgacctcgtgaagatccgcttcgccgtgagtgatggattggaactgagaccgaaatataatggaattttacattgcttgactaccatttggaaacttgatggactacggggactttatcaaggagtaaccccaaatatatggggtgcaggtttatcctggggactctactttttcttttacaatgccatcaagtcatataaaacagaaggaagagctgaacgtttagaggcaacagaataccttgtctcagctgctgaagctggagccatgaccctctgcattacaaacccattatgggtaacaaaaactcgccttatgttacagtatgatgctgttgttaactccccacaccgacaatataaaggaatgtttgatacacttgtgaaaatatataagtatgaaggtgtgcgtggattatataagggatttgttcctgggctgtttggaacatcgcatggtgcccttcagtttatggcatatgaattgctgaagttgaagtacaaccagcatatcaatagattaccagaagcccagttgagcacagtagaatatatatctgttgcagcactatccaaaatatttgctgtcgcagcaacatacccatatcaagtcgtaagagctcgtcttcaggatcaacacatgttttacagtggtgtaatagatgtaatcacaaagacatggaggaaagaaggcgtcggtggattttacaagggaattgctcctaatttgattagagtgactccagcctgctgtattacctttgtggtatatgaaaacgtctcacattttttacttgaccttagagaaaagagaaagtaagctcaaagaggacaattccagtatatctgcccaaggcagcaacaagctcttttgtgtttaaggcataaaagaagaattctgcatagaaacatggctcatattcgaaattgctctatagtcattagaagccagagaactgctaagtctcctgcaatgtttttctgctttttgccttccccatatatatggaacttggctacctctgcctgaaatggctgccatcaacacaatgttaaaactgacacgaaggatagagtttcacagatttctacgttttattggtggaagctgatttgcaacatttgctaaatggattagatgaatgtacttctttttgtgagcttacttgcctggattgctttaaaattaacctttgtgcaataccaagaaaatagctctttaaaagaatgtctttgtatgtctcaaggtaaattaaggatttactgaataaggtgttgaccaaatccagaccattttattttatttttttatttatttattttttgagatggagtcttgctttgtcgcccaggctggagtgcagtggcgtgatctcagctcactgcaacctccacctcccgggttcacgccattctcctgcctcagcctcctgagtagctgggactacaggcacctgccaccacgcctggctaacttttttttatattttgagtagaaatggggtttcaccatgttagccaggatggtctcaatctcctgaccttgtgatccgcctgccttggcctcccaaagtgctgggattacaggcgtgagccactgcgcctggccagaccattttagaattgggaaattttagtgagaaaaaatgcactgtaaatatgctttagttttaattcagttgggatgcactacctagcgaaaattgagaaactatatacttctcagagaaatatctgacatctattgtcattccattgctattttttttccccagagacttccataatttaaaataaaatcctagatccagttcttgttttttggcataaatacttaatctattttaaatttataaaatctgagcttctaggatccagctgtgtcaacctttatttagcatatataactataaatcacttattacagatgctaaatagatcaccttttacagatgctgaaatgtttgggatatgtttgttgacaaggtaaatggaaatgagaaactttatacttcagttttcagatatatggatctagatcccaaataaatgattaatcttcattggtttctcaaattcaggttgaaatacaaattaatagcctttattgattttacttttatgagtcattgtagacatctataaatataaaagggcctgtacccaaaggatgccagaatactagtatttttatttatcgtaaacatccacgagtgctgttgcactaccatctatttgttgtaaataaaagtgttgttttcaaagccatctttaaatagttctttaaaaataggtcttttttttatattttggaaaaggcattgtttttaaagtaaagataaaatggtaagtacctaattgtatttactgtaatatcttataacatgcagatgaatgctttataagttaaatatgatgtattttttcatacttctggattatactataattcatatgaaatcttgatattagtccccacacggaaaaagtgaactgcagttgatatttggtgtttaagatagcaccattgtttaaataccgcctatgtactcccaaatgaataaaacataattcttgtcctctgagagcataaaaaaaaaaaaaaa

SEQ ID NO: 35 - DNA, 60 bp, Homo sapiens
agtccccacacggaaaaagtgaactgcagttgatatttggtgtttaagatagcaccattg

SEQ ID NO: 36 - DNA, 1198 bp, Homo sapiens
ggctggaaaccgtagggagcatcttctctcggactcgggacctggttcgggccggggtgctgaaggagaagcccctgtggtttgacgtatatgacgcctttcccccgctgagggagcccgtcttccaaaggcctcgagtgcgatatggcaaagccaaagctcccatccaagacatctggtaccacgaggatcggattagagcgaagttttattcagtgtatgggtctggtcaaagagcttttgatctattcaatccaaacttcaagtctacctgtcaacggtttgtggagaagtacactgagctacagaaacttggagaaacagatgaagagaagttatttgtggaaacagggaaggctttattggcagaaggtgtcattttaagacgagtaggcgaagcaaggactcaacacggaggtagtcacgtttcccggaaatccgaacacttgagtgtcagaccacagactgcgtcggaagaaaacgagactcagaaagaagttccacaggaccagcatttggaggcacctgcagaaccagtcgaaaggtctcttgcctccctgaaggacctgtatactgtgtatgctggcattcacactctactcactggctgaatgttgagcaatttttaaaccagttgaacttgtgtacactgttccttgaatctctaagggtattactggtttggccttcacattaggtcattctgggttgtcaccacagctcaggcattcatggtttgaccagagaggcaggtatatgtgaaccttatgtctccggccctcactaaaataagaaaatacactaagacacggctataaaagcacccatctacctctgcacactggcgagtatcccggtagcgaacacctctctgacacgaccggtgtcccaccgcggcggacaccacccacacgaacaaagggggggggccggcacgaagaaaaaacctacacggggagccaacgaacactacagccaaccaccgatacgtgtcagacgagacccacaacgagagataacacaaaaaacgaggcaggcgacacacgacacgaacacgaccacacgcagtagccaagaacacacctggcaggctagtcaccaccacacacagcccgacaaaaagacgatagcgccgagccgactgagcccaccacaacagcccacgtagacacgccaccgcacacacgagcggacgaca

SEQ ID NO: 37 - DNA, 60 bp, Homo sapiens
cactggctgaatgttgagctatttttaaacagttgaactgtgtaaatgtttcttgatctc

SEQ ID NO: 38 - DNA, 1532 bp, Homo sapiens
atcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtttggggtttgggatggacaaggggaggtgtggtgtaggaactggggaaagttgggggctggcacctaaggggtggttatcgtgacaggaaggaggtaggagtgcagagatctgagctggcctgccccccaatgtcaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggatt

SEQ ID NO: 39 - DNA, 60 bp, Homo sapiens
agcatacaagactgtcatcaagaaggacgagcaggagcatgagttttacaagtgaccctt

SEQ ID NO: 40 - DNA, 5228 bp, Homo sapiens
cattgtcgcccacgctgcagtagcggcttctgcggctccaagccagcgggtcctgtgaaggcgagcagacgcggagaaaggacgcgggagtgagagagggtgagtcagccactgtctaaacgataacgggaggcggctctgcggggtagggttgaattcagtaaatgggctcgtgctgctgtctcttcggagacgctgctatcttagcgtcagcgagggaaggttgaggaggagccagagccgggtcctgcagcgtttctcgccatcagcgcccgtcgccatctccaccatgcagtcccgggaagacgccccgcgctctcgccgcctagccagtccccgtggtgggaagcggcccaagaagattcacaaacccacagtttcggcctttttcacgggtccagaggaattaaaggacacggcccattctgcagccctgctggcacagctcaagtccttctacgatgcgcggctgctgtgtgatgtgaccatcgaggtggtgacgcctggcagcgggcctggcacgggtcgcctgttcccctgcaaccgcaatgtgctggccgcggcatgtccctacttcaagagcatgttcacaggtggcatgtacgagagccagcaggccagcgtgaccatgcacgatgtggacgccgagtccttcgaggtgttggtcgactactgctacacgggtcgtgtgtctctcagtgaggccaacgtggagcgcctgtacgcggcctccgacatgctacagctggaatatgtgcgggaagcctgtgcctccttcttagcccgacgtcttgacctgaccaactgcaccgccatcctcaagtttgcagatgcctttggccatcgcaagctgcgatcccaggcccagtcctatatagctcagaacttcaagcaactcagccacatgggttcaattcgggaggagactctagcagatctgaccctggcccagctgctggctgtcctgcgcttggatagtctggacgtggagagtgagcagacagtgtgccatgtggcagtgcagtggctggaggctgctcccaaagagcggggtcccagtgctgcagaagtcttcaagtgcgtgcgctggatgcacttcactgaagaagatcaggactacttagaagggctgctgaccaagcccatcgtgaagaagtactgcctggacgttattgaaggggccctgcagatgcgctatggtgacctgttgtacaagtctctggtgccagtgccaaacagcagcagcagcagtagcagcagcaactctcttgtatctgcagcagaaaatccaccccagagactgggtatgtgtgccaaggagatggtgatcttctttggacaccccagagatccctttctctgctgtgatccatactcgggggacctttacaaagtgccgtcacctttgacctgtctggctcacactaggactgtcaccactctagctgtctgtatctctcctgaccatgacatctatctagctgctcagcccaggacagacctctgggtgtataaaccagctcagaatagttggcagcaacttgcagatcgcttgctgtgtcgtgagggcatggatgtggcatatctcaatggctatatctacattttgggggggcgagaccctattactggagttaagttgaaggaagtggaatgctacaatgttaagagaaaccagtgggcattggtggctccactgccccattcttttttatcctttgacctaatggtaattcgagactatctctatgctctcaacagtaagcgcatgttctgttatgatcctagccacaatatgtggctgaagtgcgtttctctgaagcgcaatgactttcaggaagcctgcgtcttcaatgaggagatctattgtatctgtgatatcccagtcatgaaggtctacaacccagttagggcagaatggaggcaaatgaataatattcccttggtctcagagaccaacaactacagaattatcaagcatggccaaaaattgttgctcatcacctctcgcaccccacagtggaaaaagaaccgggtgactgtgtatgaatatgatattaggggagaccaatggattaatataggtaccacattaggcctcttgcagtttgattctaactttttttgcctctctgctcgtgtttatccttcctgccttgaacctggtcagagtttcctcactgaagaagaagaaataccaagtgagtctagcactgaatgggacttaggtggattcagtgagccagactctgagtcaggaagttcaagttctctttctgatgatgatttttgggtgcgtgtagcgcctcagtgaaatgcacaggatcaacagggtttgttgtaactagattgaaacactaagttgtttttactgttttggaaaatatcttaaatatcctttttgttcctaaaggagaggaaaagttgattaacttctggtttggtttagaaaaagtaatgtttgaaatacgaaggtaatttaatgttacaaattttaacactcaaatcaaccttttaataattttctgtgctaagggtccagtatttatttgattatttagtatgtttatgtttcatgacactaatttagtcttttgatacattttacattctgtttactgccacaagcactgtggcaataacttttgaattttaatttttataatagaaaaatgattaggaattgctagatagtgttttgaaagcatatctttttcttcagaacaatgtagacttccaaaatggttaacctaaggggtctttacaaaatgtgttataagttaaacataatttgggaagttttacttttgttttcttctatgaagaaaaaaatgcaggctgggcgcggtggctcacgcctgtaatcctagcactttgggaggccgaggcaggtggatcacctgaggtcagttcaagaccagcctggccaacatggtgaaaccccgtctctactaaaaatacaaaaattagctgggcgtggtggcatgcgcctgtaatcccagctacccaggaggctgaggcaggagaattgctgaaacccgggagtcagaggctgcagagagccgagactgggccactgcactccagcctggatgacagagtgagactccgtctcaaaaaaaaaaaaaaaaaaaaaaggaaaaaaaaaaaagaaaaaaaaccatatgtgtattagggtgactgagtggtgacttcatttataataatacagagaatagctataagctcattgacagtaaaaacaacaaaccaggattctactgtttgaaaagaagtttcgttttaattttggaatttagaatgtgtatttgcaaagtcaccaattttcatctaaaaggttatattctagttgtgtcaccaaatcatcaaaaaaccttaaaaaagaagtaacttgctttgtaggtttgtattgttgatctaaacctgatacatgcttcatttaatcaggaataatccttttttttctgctggacatgtataaatttcactggattgtataaatttttatctattgccttaaacatttacatgattctcaatatgttttagctgtacagttttggtgttcatcttagaggattcttcagcagaagtgatatttctttactgttttgtgaggtaatactgattttgaaaatatatataagctaaaaacagtatttcgttgatatcagtagtcattgtgttaactataaagtcaagtgccagcaaagaactttaaaactgtaaagctgtgtatagaactgttttgtgtagcatggaaatattctgtcagctttttaaagtcactaaatgttcttgattatcagcttgaaggtatttttgtattacaagttgacagttgctgggtgtagtggctcatgcctgtaatcctagcaactcggggctgaggtgggaggattgcttcagcccaggagtttgagaccagcctgggcaacatagcaaaaccccatctctacaaaaataaaaaatatgtctgggcatggtggcccaagtctgagtcccagttacttgggaggatcacttgaatgtaggatcacttgagtctaggagttcggggctgcagctatcatctgcagctataatcatagctcactgcagctatgatcatgtctcagcactccagctttggcaacagaacgagatcccatctcttagaaaaacaaagttgatagttaaagaacataagtggatgatggcatttgaggccactagtgaaagtatgttttctctaaaatatttctctaatagtgatataaatggctattttattatgatgtttgtatgtgttttgtatttctctgtaaaccatgctccagtctttgtttttctgttaccataatgtaagagaaggtcctggaacagagactaaatcccacgaaactgacattgttaaacacactaaaacagaagtacttacctcttgaagatttaatatataatggttgacatgatacatgtacatgatgaatgaccagatgcttatggtctacattttcctttatcctgttagtattaccttccttaatctttgttcattaacatgctaattcctcttcagtgtttattttctagtgacagaatgctaacatttcttacaccctggcagaagggagagaaatgtgttttggggtgggtaactaaatttttgagtgaaatatcataagatgagaatggaaagagggagacacaaagagttataacaaaaaaacaatggtttttttagccatttgactggctctttaaatagtctacaagacattcacgtttaacatcacttttagtgaaataaaatgtgccatactagtatgtgcttcaaaagggcaaatgtgctttagtgccctaaggctaaattttggtcatttgacatcagagatgttgtaagtattgcacttaatacgcacctatttctcaatagtgttattttttggctagcattttctttaccactatcttgttgatagctttttgttctctaaggttgaaacatgacagtgcttatctcaaacagattacccatctgcagaactaaggaaagcaatttatgtatgaaagaaattcttgaattcgtcattctcaacctttgaattaaagcttagactaaatagtaatatatcgtgggaaggattttggttttgtgatatttctgtgaattaaggaatagatgttaaccattattttgtagaaaagtgatttgtatgtggttaattataaataaaactggtacc

SEQ ID NO: 41 - DNA, 60 bp, Homo sapiens
tgttataagttaaacataatttgggaagttttacttttgttttcttctatgaagaaaaaa

SEQ ID NO: 42 - DNA, 4298 bp, Homo sapiens
tcgtataagaatcacagttctttatgatgtatatgctattttttgctgctaatctccagattttgtggatataaaatatattgtcatctgattttatttttttccaataaaatgtgatttcagtgatctttattttttctatctttaagtaatatatccctatactactatctcatcacttgtttaatttttgctaataagaatttgtcagttttactctttttttccccccaagggagaggcagctgttgggcagattcctttttttttaaaaaaaaaaatgtttttgaggtatagtttatgtccaataaaacgcacacatttaaaagcataccttgataggctgtggtaaatgtacacgcctttgtggccagaccattttcatcaccccaggaagttcctcttggctttacagtcattgctcatgtcctaggtaatcactgatcttatttctaccactatagatttatgttgtctcttctagaactttgtataaatggatacatgcagtctattttttgtgtctggcttttgctcagtataatgtgttgagattagttcttgttgcatatatcagtaattttattgctgagtagtattttgtatgataatactacaacttgttaatccattcaccttgggtggacattgggattgtatcaagtcttgggctattaggaatacaactgctgtgaatattcttgtacaagtcattttgtggacattttttcccttttgggtaaataccagatacatttgctgagtcgtagggtaaatgtgtaactgtataagacactgtcaaaccattttccatagtagctgtagcattttacacagccatcggtactacttatgagattccagttgctccacatcctcgctagatattgtcagtcttttaagtttttttctttttagttacattgaatgtataatggtagctcatggtggttttactttccatttccctcatgtacatgtcttaattcattgtacatctttagtgtgtttattggttatttttatatcttttgtgaagagtatcttttggccacttaaaaaaaatgccaggtcatttgagttgtaacactttatatattttgtcagatgtaagtataattaatattttttttagacttcagggaaactttagttttcaaagcaatctagttcaaaaatgagtggaggttaacagagaggaaaatatgaaaccagagagaatcaaacagacagaataaggggggactggcagttggtcaggggcgtctgtgacagatcttctctctcttggaaatgaggtcctcacggattctggtcagttcatcattttcttcacgtccacggttctgcttcttcctcaggctctcctcgaaggccaagacccctgtggctccaacttgagtgaatattttctttaggtttctggtttacctttttattttctgaagcatctttttaaaaaaggctttagtgtgattgtctattctatcgatttttctccttttttgcttaatgcttattttctgtccaagacgtattttgcctaccatggccacaaaaatttttgccagtgttttttcctagaagttttatagttttagttttcacatttaggtctataattcatgtagaattaatttctctgtgtatgatgtaagatagagatttggagtcttccccaccccaaatgcagatagcctgttgtttcaacaccatttgttgaaaagagtattcttattcctttgaattaccttggattttaccccctccccccaaaaaaatcagtgaatatatccaatgcgtgtgtattttttgactccgttgtgttccactgacctcttatgtctgtctttactccagtactgcattgtcttcccttactatattatagtgagtcttggaaagtgctaagagacactttgttgaggaaagcctgttcttttctctggaatttgtaatttgtggtaagcagatatataagatttttgaaaaataattttctgtgaatatttttaagttctcaatctgactgtgagtgaggtgcattaaagatgttatttgaagtgaacatgaaaaggaaaaacttggttgttattgactggaactctggattcgtatattcagaatggttggtgaagcagtgtagctagttgcatctgtggattcctcttggttgtagtttgtactgcaaaatattgcttcctaatgattttttttttgctggtaaaaaccataaaagtatattcacattgttgtgaaacagattgccgaaactgtttcatcttgcaaaactgaacctctgtggccattaaacaacagttccccttctcccagccctggtaaccaccattctactttttgttcctgtgaacttgacatcatgtaagtggaatcataaagtattacctttttcctttttatgactggcttatttcattgacatagtatgtaacaggatttccttttttaaaagctaattgatattccattgtgtgtctattccaccccccctctcccattttgtttatcagttcatctctgggtggatatttgtgttgtttccacttcttggctcttgtgaataatgctgctatgaacatgggtgtgcagatgtctcttggagtctgtgctttcaattttttgggatatatattcagaagtaggattgctggatcatatgatagtttaaacagcaatttcctttggttgcagttttgatactgagagtagtacagttgacccttgaacaatgcagggtcaaaatgcaaggcaccaacccctgtgcagttgaaaatctggttataacttttgactttgtcaaaactgctaagtatagcctactgttgactggtagccttaacagtaacataaacagttaacatatatttgtatgttatatgtattatatactgtattcttacaataaagtaagctagagaaaagaaaatattactaagaaaatcataagggagaaaaattacattttactgtactgtatggtgtttatcaataacattagtttacgttgtctgtttataagatatgtcatctgttaataaaatatgtcatctgttagaaattgtaggcaaccacagctgcagatttcagtccgtggtacatatcaagcaattcaacttttttatttttatttttatttttatttttatttttttgcattttaaaattaaagacaggatcttgctgtgttgcccagattggattcaagctcctgggctcaagtgatcctccggcctcagcctcctgagtagctgggatcataggcatgcaccactgcttctggcagtttttttcttgtgatgtcatgccttctctctgcttcttgggagcactttcagcatcactaggggcactttgtataggactcatggtgttatttaaagtttatggtattgcagtaatcatgatgaaaaataatgtgaaaaccgtgagagatcactttttactgcaatacgcagtttgttggagacatgaactgctcagcagagatgattagcatcacatggtgttttacacaaggtgttttaagcagatacttgtaacatttgagtacactgagataacaggaagtggctatgaagttaacactagtacactactgtagttaattttatgcagttatgaattaatactccatctttgtttacatttctctctaacttcatataatagatttgtatgttttatgatagtaagtgataaaataacctcatatctaggtatgttttatgcattcatgacatacctaactttttcttaatgttttcgttatttctaggctatgcagttgttctgtgagttttttcaaattgtcaagtctgcaaaaatttttccagtatatttattgaaaaaaatatgcatataagtgggacctgcacagttcagagccatgttgttcaagggtcagcagtagtcattttcatgattagatgtagagtgagcatgcagcaagttgtgaatatgaatacaattgaaacagataccactcttgaaaggagcacctctttttatgtttgtttcttttgcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaaaaaaaaaaaaaaaaaca

SEQ ID NO: 43 - DNA, 60 bp, Homo sapiens
gttcaccatgggatgatgtctgtaacatcagatattgttcaactagactaggatttaata

SEQ ID NO: 44 - DNA, 2184 bp, Homo sapiens
ctatgctttctcatccggccggcttgctttcccctgcggtcgtccagactattgggcgctagcgagacgaactattggtacggggctagagaggaaggctttgggattgccggggagcagcgagcgaccgacttccgtttccagttaccaaggcacgaggatccggtgttccaacccagggggaaaaatgcggcctttgactgaagaggagacccgtgtcatgtttgagaagatagcgaaatacattggggagaatcttcaactgctggtggaccggcccgatggcacctactgtttccgtctgcacaacgaccgggtgtactatgtgagtgagaagattatgaagctggccgccaatatttccggggacaagctggtgtcgctggggacctgctttggaaaattcactaaaacccacaagtttcggttgcacgtcacagctctggattaccttgcaccttatgccaagtataaagtttggataaagcctggtgcagagcagtccttcctgtatgggaaccatgtgttgaaatctggtctgggtcgaatcactgaaaatacttctcagtaccagggcgtggtggtgtactccatggcagacatccctttgggttttggggtggcagccaaatctacacaagactgcagaaaagtagaccccatggcgattgtggtatttcatcaagcagacattggggaatatgtgcggcatgaagagacgttgacttaaaacgaagccattccaaggacagacggctgtatggaaaggccgagctttgtttcctgtgtttgtgtggactccaccatcatgttgaattttgtcaacactctggcctcttcagggacttcttatttactgtactctctatcactgacaaatgcaggctggattcttattatatacagagatggctcaaaaatggggtttcagatctttgtgacgaaatagaatactgtttcatatttgaatcagagggcttcttgttctgagaaataggttcaaaatcattggaaccaggaacaagaatagcttattgttatctgtgataacactgttttctaaacacaaggattttcttttttattaatatgcaacatagacattgccataacagaataataaaccacatgtggggttttaaaaatgaaatttggctaataggagcaattcagctatttttctatacagtaattggtgtgtggtatagaagaaaaacgggttcaaaccccacttctgccacctaccagctatatggccttgaatgagtcattcagctttaataaggttcattttcttctgtttaaaaagacacaaaacttgaaaatcagctttggccatctacctgagaattagaaagtctgatttttggaattagaaatcatgattgtaggctgggcacagtggctcgcgcctgtaatcccagcactttgggaggccaaggcggacggatcacttgaggttaggagtttgagaccagcctggccaacatggtgaaaccccatctctactaaaaaaaaaaaaaaaattaggtgtggtgacacatggctgtggtcctagttacttgggaggctgaggcaggagaatggcttgaactggggaagcagagcttgcagtgagccaagatggtgccattgcactccagcctgggcgtgacagagtgagactccatctgattgtaaagcatctagtacagtgtacagtgccttggaaatgataggtatggaataaatggtaattatttttatattatatatattatgtattcctgttattaagtgtagagttttatgagtataatttgattttattaccttcttttttacaagctgttttctcagtatttttcttggatgggatgacgctaggctggaaagtttttttcatcactatgattttataaaacaattttttctatgaacctttacttacttgactggattggactaaaagcactgatcagaggccacgacataaaaattcagtccctttgtccttccccgtgcctcccaaagttactttaagatccttagaatatttctttaaatattttatagacaaaaaatttaaagactatctgtattgcaaaattaaactatttctttaatgaatatattgcttattttaagttccaaaggtgaagtctttaagaataaaacattaccaactcctgcttttatatgtaa

SEQ ID NO: 45 - DNA, 60 bp, Homo sapiens
gctttggccatctacctgagaattagaaagtctgatttttggaattagaaatcatgattg

SEQ ID NO: 46 - DNA, 1375 bp, Homo sapiens
cagaagagtcttcatgtggacagtctcagggacaccatgtagagaattttggtctcgcattcagaaacagagaacagcagccagtggttgttgagcacagtagcaagagcaaacacaggcacacctcatcctcagtgtgctccaccgtttacgcaagccgcagcatacacaccgacctgaagatcgtcccagaagctcgttctggcacatcctctcacgctctacaagcaagcttctttgcgctctccatctctctccctcagctcacactcggccacagcaccatcctcaccctgcgccacgcatcagctccgctcctcaacacgattccaacctcctatcctgcgaccatcatcttcacccctcgcatgcacctatggcgctcccatgcctaagctcccccctcacacctcccacagccacctccccaccccagccactgctgccccagcgcccaaccacccacggccacacacaccccacacagcgggcccacacaaccctgcggacccaccctacacgcgtgcaccttgaccgcacaccgcggttccatacctgttggggcaccccaaacacccacacgactcctacacaccacccgctgcgcactcccggcgctacacccatggccacaccccaccccaaccgcccagcgccctctccactcgctgaacctccgcatccaacgcgaaccacgaaacgacacaccttttccctcccctctctcgctcaccccctacccaccccaacctaaactcccttcacaccacactttttaccctggccacccacttggtcaaacttcacccctgcgccccaactcctctcccaactactcccttctctccctcacctgccttccgccgcaactctcttctcccctacattgcccgcgcttttccctgaccttcagcgtccaacggctcctcggcccgtctacccgtccccttggcgcgctttcccttgtccctgccctctccccccacgcgttggcccccgctgttcccttccgccgcaatcctctgtgctccttgtactgccttgcttctcccgccgcttggcgccgaccgcagcgtccctgcacagcttgacccacacccctcctcgcgaccccactccaccccccgcctgaccacctatcaacacacactccaaaccacagacacggggcacaccgcgcacgcgctccaccaacccgccgcctaagacccgcccctaccagggaaaacaaaggcaccaaaaccaccgcaacacaactcaaccccaatacgccgctcacgcccccgctgccacgcgcaacccccgccatccccacccccgcaccccgcggcaacacccaccgccatcagcacgcagacccgccgcaacacccccc

SEQ ID NO: 47 - DNA, 5038 bp, Homo sapiens
cgctttttccgtaacaaaatagcaaagctcccgactgtccgcagccccggccgctcacagatggagggtcccagggcctaggacgcagcccccagcgggaagctccagctggccgtgaagaggccgagtcgagagccgggaggcgcgcgggggtgggcgctgcagccgcgggttgtttatctggagtacggaggggaggggggagcctggaaaccgccccgtgtcccatttcctcctcttgttttcgctccggattctccatgttggacccaaactgaggagcccggagctgccgctgggggatcggggccgggggcacccgggggagccgctgcccgggccgcccgccctttgtacaggccgcctcccttcccggtccggggaggaaacgagaggggggatgtgaacagctgtggaagtcggagtctcgggagccggagcgggcccccgcccaggccccccagcccagcccagcccgcgcgcccgcccgtcctcccgcccagccagcccgggcccgcgggattgttagatggaacacggctccatcatcacccaggcgcggagggaagacgccctggtgctcaccaagcaaggcctggtctccaagtcctctcctaagaagcctcgtggacgtaacatcttcaaggcccttttctgctgttttcgcgcccagcatgttggccagtcaagttcctccactgagctcgctgcgtataaggaggaagcaaacaccattgctaagtcggatctgctccagtgtctccagtaccagttctaccagatcccagggacctgcctgctcccagaggtgacagaggaagatcaaggaaggatctgtgtggtcattgacctcgatgaaacccttgtgcatagctcctttaagccaatcaacaatgctgacttcatagtgcctatagagattgaggggaccactcaccaggtgtatgtgctcaagaggccttatgtggatgagttcctgagacgcatgggggaactctttgaatgtgttctcttcactgccagcctggccaagtatgccgaccctgtgacagacctgctggaccggtgtggggtgttccgggcccgcctattccgtgagtcttgcgtgttccaccagggctgctacgtcaaggacctcagccgcctggggagggacctgagaaagaccctcatcctggacaactcgcctgcttcttacatattccaccccgagaatgcagtgcctgtgcagtcctggtttgatgacatggcagacactgagttgctgaacctgatcccaatctttgaggagctgagcggagcagaggacgtctacaccagccttgggcagctgcgggccccttagcctgccctgcttccaagcgacggccatcccagtaggggactttcccacactgtgcctttacgatcagcgtgacagagtagaagctggagtgcctcaccacacggcccggaaacagcgggaagtaactggaaagagctttaggacagcttagatgccgagtgggcgaatgccagaccaatgatacccagagctacctgccgccaacttgttgagatgtgtgtttgactgtgagagagtgtgtgtttgtgtgtgtgttttgccatgaactgtggccccagtgtatagtgtttcagtgggggagaagctgaaagaccaagactcttcccaagttagcttgtctcctctcctgtcaccctaagagccactgagttgtgtagggatgaagactattgaagactccattgccaaaccatggcctttcctcagtgttgtaaggcctatgccaaggataaaggaagggtatgcctttgggtactccaggcacacacctttctgaaatccttctccagccagctgctgcagacaaaagatcacatttctgggaagatgagaacttgtttccagaccagcatccagtggccatcaggtcttgtggcccaaaggctatgcttgcctccggctgagtgcctgggataggccttttctatgtctccccaaggctggggtgctgagcctgccttcctcaccacctagccatagtctcaaacctgtggggaaggaggttttctccctgcccgggaagaggacagataactgatttccgttcttttgactgtgttttaaaattctctttctaaacacagagtgttgggcctggtttgtttctgacaaagttacagtcctgggcctgtaatgaatgtcggcggcgctggggttgcagggaaaagacaaatcctcaaagcgtggacgtgtgtccccatggcttgtggatcagctaagctcgggatcatttccataagtctgcttttcagggattctctgctggtgctggtgcaaggacttctgttccaaaggctgggaaaaactaagctgtcccagcccctcccatttcttgggcagggctcttttcctgttgtgtcttcccccagggcctgtcctgtaccgagctctgtctgttccagccttcatccttcctggctgttgcttttcctcttaagggcctcagaactcttgctcttcctgggctgagggggaatgagtgttcttgccatttgccagcctaatgcgcatgctttctgcctctggtaacaggagtgagtgagcccctcagacctgcactctgggtgtctcctgctttcaaaggttcttaatagtgaatgctttaaaattaaagtcatcacgaaatggaagttttcccagggtggaaaataagaggaagtgctgctgtaattgggagcacaaggggcctcccaaaaaggagccccacctcagcatcactgccttaatcgtggcctccctggggtgggtggggttctctcctccctccctccctcctcctggggtgggagggcgctcctgttcccatctctgtgttccctggaggcaggtatcacaaagcatttgtgaattgctttaggtgcagggacaccacccactcaggactcttccccatcatcccttccattgccacaccctagatccagcctcaggaactaacaagttttgagaaaagcaggtagtagagcagcagcttcgtgctctcagcggtggctggctggcatttttctctagcgttgtggtgccaccttcccttcttgtcccaaggttataaggccttgtctttctctttggaatcataaagtggaacagagtccccagaactcatgtggccatttccgccagcatcactccccggtgcctatggggtcccggtgtacctaaagggagaaggaccccatgtgctagccagaaatatactgtctcttgaaggaaagcaggagctcagactcttagagccagctgtggcttcggacccaaggcctgacctaggctgctatcctaatattgcaggaggggcctctcttccaagccccaccctaagggttagcccttggccaaatcttttgccgtctaggcccagccaggcttttctgactaaataagcaataagaggctctaagctgactgagttgcaaggaccctttccgccctcccttggatctccatgtttttccagatggcggaagagcatgtgccaccccctttcctaacagacttgtccaagtgcttggcgtgggacccatgaccaaagcccaggatggcttggtgggagtgtccctgctgcatctgcatgaagcccctgctttttaggcctcactcccatcagaaccctgcctgcccacctgcaactcccccccaacaatgccattcccacttgccccagagaagctactcggccaaacctagccagggtctgttcttgtggaccagagccagcctagtcattatttgctgtcgggtttccagtttcaccgtgtgttagggtgagggatgattgtaaaatttgctcctcaaaggaatcaggccagactcaattttggagggcaagacagggaggaggccgcttcatcccagactctcttctagggcttcccaccatcagcccctcccacttgagactggtctttgggaggcaataggccaccatgcctggtcagcaccaattcaagccatgccaggaatctgcctacctgccaggttcagttcttttaaggtgcctcttcagggacacagtgtgtctctctgattgggcttctaaatcaaaagcctgatgttcgtgtccctctcatagggggagctttggacacaggaccagtttggaaaagggtcaggtaagggtttccactctgcacattgtagagggaacactctgtaggcccatgggtcccttactagagaggttgagtgaatttgccttcagttaacatgggaccttctgtttagcttcctcttgcttcccaaagattttaagcattttgtaaatgtataaactcacctctggtaacagtggcccagacgctgctttgtgctaaaagcatgggaaatgtaaaggcagtctttctctgggaaatggatgctattctattctgctgcccctacctgttcctgaggcctcatttagaaagaaaatcccctcagaaggctgtctggcacccagtgtcctagccaggccaagtatatgagaaaggtaagtccattttccccttcaggtcctcagtggattacttaaccactgctgtccctcggtccctttttcctaaacgggtttagttctgtcttttttctccttttttctaaatgctggtaaatatttacattcagccagggaagaggaggccagaggtcgggccagctgccccattcttttaacgttgtagggcctgcccatggagcggaccctcctctttgggcctcgtgagcttttttgcttatcatgttccatttcgtgccgctttcccccttcaagatgccatttggagggtaggggatctgcttcccactgtgactgggctatgggattctgactaccttgcttacagattcatggtttgataaatttgttgtattcaaaaacttgaaatgcaggacgccattaagtgtctgtttatatttttggaatatttgtattacttacaattaattaataaaagtgggtttaaaaaacctttccaggaaaaaaaaaaaaaaaaaaaa

SEQ ID NO: 48 - DNA, 60 bp, Homo sapiens
tgcttacagattcatggtttgataaatttgttgtattccaaaacttgaaatgcaggacgc

SEQ ID NO: 49 - DNA, 3510 bp, Homo sapiens
aaaaaaaaaaaaaaactagaaagctacggaacctgccattagtattgtggtgtatttttaagattaaaggtacactgatggacaaaaaaaaaaaagtaaaacatggcaaaaaataaaataactcctatactgccctcaaaatggagtttgcaattaatatcaggatttatctttgcaaaaatcagtgatttccacattcagccagtatagccagcagaaatttctgatccacaatgcatggattcctttgaagaaaaaaaagaaaaagagaaaaaaatcacaaaaacaaactttttttattcaaaagtaacaaagttcttgtaaggtaaataatgtatttagcatgaagcatgaattattttcatataaatatagaaaatagagaaaaggctatgcctgtaatttttaagccctcaggcttagagtttcttttggttttcttcttttttctttccttttctttgctttctttttttcctttttgtttttgtttttgttttttgtttttgtttttttttcgggttattttgttttggttttttgaagcaggtgtttaaggtttaaccttcttcagggacaaattctgactgttggggaacttactctgcaatataaaaatatcttcatgctctggtagggcttggatggttgaactctgtactgccttgtgtgcacttcagccccgaccccctctgattctctgttgaaaagtgtgtcctttctctctgtctgtacatgtttaacatgacgcaataatttgagggcaaacttagtagtgagtgtgtatgatagaatcaagagaattatgggacgcttacttgagaaaatcattaccatgatttggttctaggaaaaaggcagtgaataattatgcaaattagccagaagaaggggaaccgtgctaatgggccttattgggtgaggggacgagatggggttcatgtgaaggaggaagcgatgccgaggtaggaaaggccagccccagacatcctatcgccacaatgccatgtcgcaataggaagcaggggccggccatcgctaccttcagcacactgaccaacctggaattaagaccacctagattgcgagagctgaatttagaaaccagacaacgtcatgcagcccagaaactcctgttgttacctttgcctaagaaattttctttaatggcgggggcggggggcgggggtacaaagagaaatctctaaaagaatatgatcttccatccaagtggagggaaactttaaaacaaaaacacccagtactgtggctcaggatatgatgcgtgaggagagggagggaacagagatgaccttaacttttaaaaaagggactgctgtgggccaaagccaagcccatctgccaggacgaggtaatgtcagagctccatcagcccggacagtgggaactaactggtgcattccccacacttaccttccggtgggttgctgatgagagaacctgaaaaaacctacacctctacagcaggtcgaattcatgacctgaagctgaatacttccagcatatttattcagggtgtaggtgggaataaagtatcttcgcagtgctctgttccctccgtctccccagacatctgacaccctaaaagccatccacagctatggaacctgagcgacaccttgatttgtgttgtcacctgaccaagcctaaagacctccagctcagtcccccaccttcatcccaccccacagatgataaaattcagacctctctcctgaaaggcagaggttcaacattcaggactgtttctggccgaggacttcttccaattaaaacccccaccgtgggctgtctcccctcatttcatttttctaaaggggcagaggcctcttttagaaaataataaaatgcaatgtgtgtgatttacttttctgatctctttgagaaatagagaaatataaaagtgtgttcttaactccagaaccactctttttgcataaatacctcatcgggcagctttctaagtgtgattttcctgagtctcccttcgttggatctgccggaagacttgtcggggaacctttagtgagggtacttcttcctatttttcttctgtttttggaggcatacacattatgcataaccaaaacaatggctcaattgtgtttaactttgtattttgattgttgagaacaaaaacaaaaagtatcaatgtgtatgtggctgtttgtagtgaatttattggagaatgaggttgtccgtgtccttaacaagccaaggggcaggaggcaccctctcttatcccctcctccaagagcagtagagaatttaagcacaagcctatttgtgaaagaatattttgcttaagtgtcattcactttagtcttggaattccttcccaaacgtcaggtgttcttttagcttcactgaccaaaaattaaggaaggaaaacacagtttttaaaacgatccatcttttaacagccgaaaccgatgtgtctatggtgctgcaccttgctgttgtacttctgaaatcagacgtgtgtgaacgatcatttctgacttaaccgtgagatgctcacgagtacccttcctgttgttttgttagcattgaaatcgagactatttatttggaatatatacaacagtgtttttccactgtatttcatttgcaaaagttgagaactgctttctctaccttttgcaaaataattgatattccatattggattctcaaagacttcgatatggtgaacctattaaacctagaaattgtattcatcttttcatgactgtggcctgagttccccagcccctctcctccttttttttagatgagatttagcacactctcagttatttaaacatgcaacatttcttgagtatgtatgttgaggccatctgagctcatagctgattcagtaaccagtttcatgctgtgtcattcacactcactacttaatactgccatggtgaaaatgtggaggaaaaatgtatccatgtgtgtctgggaagcatatacacttgtacattttttaatactctgattctgtaacatttctgagttttgttttgttttacagaaaaaaaaaaaaagtgataaagcaatcagaagaccaagaggtttactattgatgcttagggtcgtctgaccttggctggccaatagacctacacggccaaattaatttacgagagtaataatttttcaaaagccaattttttttctgtattttctgtatgaaactgccaatatcatgaatagaaagggagaaccataaaggagaaagaacgtgatgttctgttatgttcatgtaaacctaaagaaacagtgtggaggcaggcgcgatcagccgaactctagggacttggtgttgcttggaaggcatccatacctgcattttgcattcttcgtatgtaatcatattgccaaagacaaactatttcatcatttattgtaaataacacttttccccagacctaccataaagtttctgtgatgtattgtcttccagttgcaataaaaattactgagttgcatcaattgaag

SEQ ID NO: 50 - DNA, 60 bp, Homo sapiens
gtccaggaaattacaatagctgttaaggaaaggaaataatggtacagatctttttctgtc

SEQ ID NO: 51 - DNA, 2074 bp, Homo sapiens
ccacgcgtccgggctcggggaggtttccgctgaggcggcgggggtgcggcggtgggctggtcttccgcggccggcgttgcgccgcggcggagggtgggcgcgcggggagcgggatggagccggggctgtgaggccgaggcggcggtgcctgggaggaagggtcggatgccggaccgggggcaccgctgaggcggtgggtccccgacctgcgagacaggtttggaagcccccgctgcgcccagtccgtgcggaccgcgaggtcgcgggcgggtggaggcgcgtctccggcacgatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagctctgttgcccaggctggagtgcagtggcccgatctcagctcattccaacctccacctaccaggttcaagcgattctcatgcctcagcctccggagtagctgggattacagctcctggacctgaagcagacctgcagagaggatcaagtgcagagacaagctgctgctgagatcatcataggggacctcttctaacatatgagttcctgaggaagtgctgtgaccttccaatgctgccactggtagtctcatttcaaagagtaaaatgtgaaaatccaatggcagcagctattgtgatatgccagacagcaggaattgggactaaaaatcaagggatacttgtgataatagatccatagtactttggagctggaagaaacccagcttcaaaaaacagcttgatttgcagctcttcattcaaaaagaatcccatccagggtatgacattgaacttactcatcacgtctctatagtgtcttctggagtttggaactaagacccctagacagcagagcctaagggaggaatgactctaccaggagacaaaataatgactctgttaaagttgagatggccggctgcctcatacctctgattcaaaagtaaaggagttgctgtactggttagggcgattgttcctgacaaccaaggggaaactggactgctacacaaggaggactgaacagagctgaggcttccctaatgaagacattctgctgtggtcagaagtttcagcagcccctgagttcctgcctgttcctcctgaaagccttccctatctgtggataatgggcttgccttgccaacttccacaattgcataaaacaagtccttgcaatgaatctcaacatgtattaaaaaaaaaaaaaaa

SEQ ID NO: 52 - DNA, 60 bp, Homo sapiens
acagtgcagtaagttgaaaactcagtatctatggaattgataaatgttgatctggtgtag

SEQ ID NO: 53 - DNA, 5344 bp, Homo sapiens
ttccgtaaagcactatgtggaatgctttgcattcttgtccccatcttagtccactgaacgtccctgtaggatgagtagtgtttttagctctattttctagattagacaattgaagaagtttctgagatgacgtgacttgctctaagaagtggaggaaccaggatttgaacccagttctctgttccccaagcccatgtgatttcattacctgagttgtcggtgtcacgggatcccccaggtgggtgggtggcccagtcattgtgaatcatttcaacatttcttgttcataatgtgttgtatgagcccacccttggctttggcagacttcctgtcgatgggccaaacagtgttgcccggctaagaaggtggtgttctggtttacgccacaggttattctcagaacacaaaagtgtgatttcaatcttctgaaaatgacttcgtgtagatgctttattttattctacttggatatgcctgttcgtggggatgactgtgccgacattcctttcaacagcacaactgaggtgtttatagagaaagatgagttttctagaagtttaactggcttttgcttttgtactgaactgttatgagttgggacaatttaaacattaactttggtgtcttgaagtcacttgtttatgttaagaaacgtgggggctataccaccaaaaatctattataacagtctggactggtggtaggtttttttttttttttttttttttttttgagatggggtcttgctgtcgcccaggctggagtgcagtggtgcggtcttggctcactgcagcctcctcctctggggctcaagcagtcctcctacctcagcctcccaagtaggtgggaccacaggtgcatgccaccaccctcggctaaatttttttttttttttttttttaacgtagagacagggttttgccatgttgcccaggctggtctcgaactcctggactcaagtgatcctcccaccttggcctcccaaaatgctgggattataggcatgagccactgtatccagtgacagtagacctttagtttgctcagtgccacattgctttttgaataattcctgcctatgtgacctttaaaattctgggagagagaaacatatatatggaaggagctcagaattacagttgattgggcttggtcataagcatccttgctgaggcaatacccttccagatccctctttctcaaatagttggagtgcagtattgctatttcatgggcactttgagacaaaagctagctctgatttaactagaatctagtcgtgcaagtctttaaagttgaagctttagaaaaattgcatcatttttggctgcattgcatgagctagcctgcatgttcagcagctgtggaagctgttacaagttgctatgtgttaagaacaagtctagttgtgaggcagaagctctgctgtggttgtgccttgtgccattacctgcctttgacaagcccagggacagcagtgctttgcatgtcctcatgttgaagtctcacttgcaggtagttaccttagaatgccaaatacgctgtcgggttgatccagttataaaaggctcatatcacagacgtttatattgagctgtatgctattatgaataaggaattcttatgatagctagaaatcacatgctttggaactaaaaatagaggacttcctctcacgttccctccctgggcctgtgctgcgtcgtcgtgctgcgtatttggatactatccttcggagcgccacactcgagtgatgttgctcaggcagtgtctgaccttggtgagaggagagttgctgttcttgctgctccgtttagagaaaggtgccttccatgctgatattagaatgcttcctataggtggaatgcacgcttcctgtttatcttctaatagccacttaggatatgagcatctaggatctcggcacagagggattcagcgtggtgggagatgcgggaagaaatccgtaatgacagactgttgtcattactgttggaacctccccaggaccaactgaaacttgaagggaaaataagagtttaggttggggagggtatttgaggcagaatgaattccctgtgggctaacctactatgtccaagacaaacgtgcaggttattgtgaggatgggtgctgtggcagccgggtgtgggtagtaggtgctcagtaatttctcctacgatggtgtgtatttcccatgctaggatgcccctcggctccgcttctatgtgtcttacaataaacattttctctgaaggcttgcatttcattttcccaagttggagacaagtaagcactccctcctcctccattatacccattggtctctgcaaatgcctgtctcattcatctttagagagcacagggcaccctcagacttgtgaacatggtggcagatgagtcgcgtggggaggtgcgtgttgaggggctcactggccctcaggagggagtttgctgcttctgtgcaatgggtgtgagatgggccatccttgggaactcagccatgatctctctccacacaggatctggagtgggagagcaggatgggggactgatcggtgccgaagagaaagtgattaacagtaagaataaagtggatgaaaacatggtgagcctgttctttcttctgcccaacacgctttacttttgagactcattagagcgagtgacctgatgtcagatgcttccaggtgcacgtctctgtgttcgttttccgcacagtagaaggttggagggctccaacggctcccacagactggctgtggtgtttagcatctgggtatgaaaaggattaaaaagcccttttcagcagtagctcatctcttgctatagagtaggaaaatatatttacaactaaagatatgaataacctgttagaggccattttcaagtgagtagagagttaataacttggattagagttgggttttgttcttatactgccttaggtttatacccccttttattcacctagtattttctgtcatttatagttctggattatcttcaactgagtttgatatttcaacgtggctttttttttttttttgaaatggagtcttgctttgtcaccggggctggagtgcagtggcatgatctctgctcactgcaagctccacctcccgggttcacgccattctcctgcctcagcctcccaagtagctgggactacaggcgtccgccaccacgcctggctaattttttttatttttagtagagacgaggtttcactgtgttagccaggatggtctcgatctcctgaccttgtgatccacctgcctcggcctcccaaagtgctgggattacaggcgtgagccaccgcgcctggtgtaaacggggctttttggcagtctgttctgagatacgtctccacaacggttacttgaaggaaaatgcatacgggaccagctgccataatatagtcttccctccatacctgccccttcattaggggtttggggagtggatttggaaggctgtgacaggactggttggttaatgggggtcccacaggtacctgcttccttccatcaagcagcaggtagcagaggaaggaggcagtaaataccaaactccccgttcacccagttgcttgctgccgacattctcatgactgtttcaggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactgtataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaggcggccgctggtccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttccaaaaaaaaaaaaaaaaaaaaaaaaaaaaaaaaa

SEQ ID NO: 54 - DNA, 60 bp, Homo sapiens
aacttcacctacaaactccttaatatgatctgtggagaatgtacacagtttaaacacatc

SEQ ID NO: 55 - DNA, 4197 bp, Homo sapiens
agcgggtggagctgccagagtaaagcaaagagaaaggaagcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaagtttcagagcatattcctgtttatcaacaagaagaaaaccaaacagatgtctggactcttttaaatggaagcaaagatgacttcctcatatatgataggtttgtacatacacacaaacacatcccaaatttaaaaataactgtttcgtatctatttatttacttcccatcacacataacaatcttctttactgttaaatacaatgccatatttcagtcttcatctcatataatctctctttaacatttagaagtaaaaatcactccttatttttgaaatactctcattttaaaaaatttctatgacactataccctgctggttttcctcatatccttcctcttctttctcctcctccacacttcctcctcttccacctcctgatttttcttcctcccacattcttccttggtttattctgtatgtgtttgtgttattcagggctatacagctttctgcctattcacactctgcacattttacctgagcaatctcatctatcccttgattacaattaaaacacatattaggatgatcccatatatacaaagctgaaacacaatgactgaactccagacgagtctacttcctagacatattcacaaacatcttaaatttaattattcaaatctgtattgattatcttctcctaaaacatgcttatactttcacttttgtgtgatttttatatacaacctattggaggcagatgcagccaaccactagggcatataatcctataattttcagaccctgcactcccagtcatcatccactattttgcaggacatcacaaaaaccatcaggtatggcagccttgctgccatccaccccttcacaaaactgtgtgacaggaatgtattacttactccttccaccacacttcccacctcagtcagtaatcaaattctatgggttcttaatcctgagtatatttatctcatatccgtaattattatctcaagttacttcctggtgaccactcctctagatttttccactaatctcttcacttgatttcttcttgttttgtatttaatagtaagtgatttaaaataatatatttgcttttgattattgccaaatagtttataaactctttattcacatttatttttttgaaatgactttgatttttgaaatgactttttaaaaagtaaggcatgtaaaagagttcaccattccaagaggaaaatacagaaaattgattatccccataaattggcatttcggttaaataaaaagaatgaccaatttgtatatcctgtacaattctaacctaattcttttgcaaatgaataaccatatcttctaattaattttaatctaaataataattttaaggctacatacctgaatttctgaactgtaaagtgagttaatcatttaagcatgatctgcacaaatctacttttgattctatgaacaaataaaacatttatattttgagggaatctcaattcatgcattatgccattataaacattcttagttggtgctttgttttttttgactctccggagtctggtgagccctacttggtcttacactaaatttttaaaaattcacatttcattcttttaggcctttaaacttctaatttttaggataacctaaaagtataaccctttgatagtcacataaaaccatatatactaggtaaaatgtaggcaagaagaacattttaaccccaccatttctgacaatgccacatgttctaatactttcattgtgctgaaattttcattgcattagatacatttttaaataaatgggctactggccaaggcttggggatgtttttgttatgtgatgatttcttgttgtgtcaaatttgtgctgccttagcagttatgacaagctcaagtgattttcagagcctaatttataagttagcggtttgggcactggtagaatttataagtcagtcacaaaattgtattttaccaagtcacagtgatgacatttttgatattatatagtgacatatctataacatttcaaaatactagtattagactaattatagtgttgctatgacctgacctggtgtgcagtacctgggagctcatttgtagctctcatccaaagaaatttagtaaaggcgtgaaagggtcttagttatgaccattaaacctataatacctatcccagactgtatttgagtaggatcgtgatacagaaaatattatagtgacattgtatttgtcctttttcttagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaaagccaaaaaaaaaaaaaaaa

SEQ ID NO: 56 - DNA, 60 bp, Homo sapiens
gtaagtatttccatagtcaatgatggtttaataggtaaaccaaaccctataaacctgacc

SEQ ID NO: 57 - DNA, 4167 bp, Homo sapiens
agttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccagtacacagtgtatagtcaagccagcaccatgagcattccggttgcaatggagacagatgggcctttatttgaagatgtgcagatgctgagaaagacagtgaaggacgaggctcatcaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaaaaaaaaaaaaaaaaa

SEQ ID NO: 58 - DNA, 60 bp, Homo sapiens
gatttcactaacgttgtatatgaaaatgtctgcaataaaaagtacttttaaactttgtaa

SEQ ID NO: 59 - DNA, 2700 bp, Homo sapiens
cgcagaggcaccgccccaagtttgttgtgaccggcgggggacgccggtggtggcggcagcggcggctgcgggggcaccgggccgcggcgccaccatggcggtgcgacaggcgctgggccgcggcctgcagctgggtcgagcgctgctgctgcgcttcacgggcaagcccggccgggcctacggcttggggcggccgggcccggcggcgggctgtgtccgcggggagcgtccaggctgggccgcaggaccgggcgcggagcctcgcagggtcgggctcgggctccctaaccgtctccgcttcttccgccagtcggtggccgggctggcggcgcggttgcagcggcagttcgtggtgcgggcctggggctgcgcgggcccttgcggccgggcagtctttctggccttcgggctagggctgggcctcatcgaggaaaaacaggcggagagccggcgggcggtctcggcctgtcaggagatccaggcaatttttacccagaaaagcaagccggggcctgacccgttggacacgagacgcttgcagggctttcggctggaggagtatctgatagggcagtccattggtaagggctgcagtgctgctgtgtatgaagccaccatgcctacattgccccagaacctggaggtgacaaagagcaccgggttgcttccagggagaggcccaggtaccagtgcaccaggagaagggcaggagcgagctccgggggcccctgccttccccttggccatcaagatgatgtggaacatctcggcaggttcctccagcgaagccatcttgaacacaatgagccaggagctggtcccagcgagccgagtggccttggctggggagtatggagcagtcacttacagaaaatccaagagaggtcccaagcaactagcccctcaccccaacatcatccgggttctccgcgccttcacctcttccgtgccgctgctgccaggggccctggtcgactaccctgatgtgctgccctcacgcctccaccctgaaggcctgggccatggccggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctggtgatcgcagattttggctgctgcctggctgatgagagcatcggcctgcagttgcccttcagcagctggtacgtggatcggggcggaaacggctgtctgatggccccagaggtgtccacggcccgtcctggccccagggcagtgattgactacagcaaggctgatgcctgggcagtgggagccatcgcctatgaaatcttcgggcttgtcaatcccttctacggccagggcaaggcccaccttgaaagccgcagctaccaagaggctcagctacctgcactgcccgagtcagtgcctccagacgtgagacagttggtgagggcactgctccagcgagaggccagcaagagaccatctgcccgagtagccgcaaatgtgcttcatctaagcctctggggtgaacatattctagccctgaagaatctgaagttagacaagatggttggctggctcctccaacaatcggccgccactttgttggccaacaggctcacagagaagtgttgtgtggaaacaaaaatgaagatgctctttctggctaacctggagtgtgaaacgctctgccaggcagccctcctcctctgctcatggagggcagccctgtgatgtccctgcatggagctggtgaattactaaaagaacttggcatcctctgtgtcgtgatggtctgtgaatggtgagggtgggagtcaggagacaagacagcgcagagagggctggttagccggaaaaggcctcgggcttggcaaatggaagaacttgagtgagagttcagtctgcagtcctgtgctcacagacatctgaaaagtgaatggccaagctggtctagtagatgaggctggactgaggaggggtaggcctgcatccacagagaggatccaggccaaggcactggctgtcagtggcagagtttggctgtgacctttgcccctaacacgaggaactcgtttgaagggggcagcgtagcatgtctgatttgccacctggatgaaggcagacatcaacatgggtcagcacgttcagttacgggagtgggaaattacatgaggcctgggcctctgcgttcccaagctgtgcgttctggaccagctactgaattattaatctcacttagcgaaagtgacggatgagcagtaagtaagtaagtgtggggatttaaacttgagggtttccctcctgactagcctctcttacaggaattgtgaaatattaaatgcaaatttacaactgcagatgacgtatgtgccttgaactgaatatttggctttaagaatgattcttatactctgaaggtgagaatattttgtgggcaggtatcaacattggggaagagatttcatgtctaactaactaactttatacatgatttttaggaagctatgcctaaatcagcgtcaacatgcagtaaaggttgtcttcaactgaaaaaaaaaaaaaaaaaaaaaaaaaaaaaaaaaaaaaaaaaa

SEQ ID NO: 60 - DNA, 60 bp, Homo sapiens
ggggaagagatttcatgtctaactaactaactttatacatgatttttaggaagctatgcc

SEQ ID NO: 61 - DNA, 692 bp, Homo sapiens
  misc_feature 488, 606, 639, 656: n = A,T,C or G
  misc_feature 488, 606, 639, 656: n = A,T,C or G
acttctggggcagccgtgagcagcgggcacacgggcagccacgaaagcagcagcgagggtggtgcaaacacctcataactacaccgaatccagtagcgcctggcgcccccggcgcgcaaggccgcctctactccgcctcatctttgtcccaagtcctttcacagcctgccttcctcaaacggcccgatgcgcccccgtctttgccggagtaagcagaccgccagcagccggcccgcaggtcagtcgaccctctctggatgcaggtcgccgggaaaacccggagcggagcatccctcgggccgggaaacgccctcggcgcgcacccactggcgcgcatgctcagtccgcgcggcggctgcgagtaggaagctccgcgcggcggcgggggcggcgacggcgactggcgggtgggagtggaggcaccggctggcgggcgggggtacagggacggggcaggggctcccgctccaggttccttgaagcacttncgaccgcgaagcccggcgcgagaagcgagctaacccaagagccaacaacgagcgcggagagggcagcggactgagcggagccgccggccaaaagcgggctcggagcccgggtctccgncgctcgggacccggctaggcggcggcgggggcngcatgttccactggatncccctgtggcggtgcaaccgtcatgtggagagcatt

SEQ ID NO: 62 - DNA, 60 bp, Homo sapiens
gaagcttatagtgggtcaaacaaggaggtgtctagtgtgttgtttaaaaagaaggcttac

SEQ ID NO: 63 - DNA, 4264 bp, Homo sapiens
acgtgcaccggcccgcgcccagcctccgctaggggaccccctccgtggcttcccaccaggttgttccaggcctcagcttcgccgaaaggcctcaccacctccgacctccgcctgccctggggatgctcccagccctgctgcggcagaacgcgacgtgctaaccggaatccctaggccgcctgtctcctacccatacttggaggccccgctcagacggtcctgaaaacgtctgaaaggcggttcctgccagagtccctgctacctgttacctccacccctatttagtcctagtggacagcctcgctcaccttccctgggatgacacttctggcgactgagatgagcgagcctctctgggctctgccgccgggcgtgggctgacctgcctacagctggggcctgataaggcagcagcaagggtggaggggaggcagtgttgaagctggggcaagtaattttccccaatttacagggaaaaaccgaaattcagaaaagtttaatgtcagccaggggctggaacccagacctctggcagctctcactttcacaatgcccttgggctgactaggctgcagaggggtttcaccccaaccccagggcacctcaggtgtccccaccaaaccttcctaacacctgaccactaagtagggaggcctctcagggggctagctgtgctaggcccttgcaactgagctgtgggacctgaggcctggcccctcatggctcctgtcaccaggtctcaggtcagggtccagcaggccctgagctgacgtgcggagccagagccacccaatcccgtagggacaggtttcacaacttcccggatggggctgtggtgggtcacagtgcagcctccagccagaaggatggggtggctctcactcctgctgcttctgactcaatgcttaggggtccctggtgagtgcccccaaccctgatccccatctgccttcaggagggggttggccccattctcctattctaggatgagaaaaaagtcagggagccagaggctcagtgggcatggggcagtgacctcggcctcttgagcacagctgggaagccctaggaacacatagacatggcccacttaggcctctattagcacgtctgctctagcactgaagcagtgttaggaccacacagatgcacgcacacagcaggcagtgacccctcctgagcctgatctacccctctaacctagcgtatgctttcgtgcaagtgagagcccagatttggagtctgaatgcctagccagggcccctggctgggtaatgtgatggctctgagccttagcattctcatttgagagatgagatggggcaagctccatcacccactgctctcacagagcatatgtgttagatctgagcccggtgcctgggccactacacagaggcaccggtgataactaccaagtctgggcctgcttcccaggggaaatttttttgacaagtatctgtgcaggggggctagactggcccttgaaagtgcatacagggtccatcccagaagccttgtagctttgatcccctgaatgaacaaagtgtggacatgccaatacacattactgacaggtatgcccacctgacctgcacccactcatgcccactctgcagggcagcgctcgccattgaatgacttccaggtgctccggggcacagagctacctgctacatgcggtggtgcccgggccttggcaggaggatgtggcagatgctgaagagtgtgctggtcgctgtgggctcttaatggactgctgggccttccactacaatgtgagcagccatggttgccaactgctgccatggactcaacactcgccgcactcgaggctgcggcattctgggcgctgtgacctcttccagaagaaagactacatacggacctgcatcatgaacaatggggttgggtaccggggcaccatggccacgaccgtgggtggcctgtcctgccaggcttggagccacaagttcccgaatgatcaccagtgagacaaacaccttccctccatcccggcctgggaccttcccccagcacacactatagtgatgctctgggccctcaggtacatgcccacgctccggaatggcctggaagagaacttctgccgtaaccctgatggcgaccccggaggtccttggtgccacacaacagaccctgccgtgcgcttccagagctgcggcatcaaatcctgcctggtggccgcgtgtgtctggtgcaatggcgaggaataccgcggcgcggtagaccgcaccgagtcagggcgcgagtgccagcgctgggatcttcagcacccgcaccagcaccccttcgagccgggcaagttcctcgaccaaggtctggacgacaactattgccggagtcctgacggctcccagcggccatggtgctacactacggatccgcagatcgagcgagagttctgtgacctcccccgctgcgggtccgaggcacagccccgccaagaggccacaagtgtcagctgcttccgcgggaagggtgagggctaccggggcacagccaataccaccaccgcgggcgtaccttgccagcgttgggacgcgcaaatcccgcatcagcaccgatttacgccagaaaaatacgcgtgcaagtgaggtgggggggcgggcgttgggacgtgctgctgcgggtgagacgggaggagggtagtcacaggcttagggctggaggctggcgggctagggctgagtgcagcgcctgcttagagaccttcgggagaacttctgccggaaccccgacggctcagaggcgccctggtgcttcacactgcggcccggcacgcgcgtgggcttttgctaccagatacggcgttgtacagacgacgtgcggccccagggtgaggcccaagcttgggggctacagagccggggctggaagcctggaaccgaagggccggggcgaggtctcggcctgatggctgcctgcacccgccgcagactgctaccacggcgcgggggagcagtaccgcggcacggtcagcaagacccgcaagggtgtccagtgccagcgctggtccgctgagacgccgcacaagccgcagtgagtccctggtgctcctggccccgccagggccctaaccctggggcggcatgctttgatgtctgggaccagagcctggaaatggttgagactaccctgccacgattttgctcccgctcccgcctcggttcacgtttacctccgaaccacatgcacaactggaggagaacttctgccagacccagatggggatagccatgggccctggtgctacacgatggacccaaggaccccattcgactactgtgccctgcgacgctgcgctgatgaccagccgccatcaatcctggaccccccccagaccaggtgcagtttgagaagtgtggcaagagggtggatcggctggatcagcgtcgttccaagctgcgcgtggctgggggccatccgggcaactcaccctggacagtcagcttggggaatcgggccagcatttctgcggggggtctctagtgaaggagcagtggatactgactgcccggcagtgcttctcctcctgccatatgcctctcacgggctatgaggtatggttgggcaccctgttccagaacccacaacatggagagccaggcctacagcgggtcccagtagccaagatgctgtgtgggccctcaggctcccagcttgtcctgctcaagctggagagatctgtgaccctgaaccagcgtgtggccctgatctgcctgccgcctgaatgatatgtggtgcctccagggaccaagtgtgagattgcaggctggggtgagaccaaaggtacgggtaatgacacagtcctaaatgtggccttgctgaacgtcatctccaaccaggagtgtaacatcaagcaccgaggacatgtgcgggagagcgagatgtgcactgagggactgttggcccctgtgggggcctgtgagagtgactacgggggcctacttgcctgctttacccacaactgctgggtcctgaaaggaattagaatccccaactgagtatgtgcaaggtcgcgctggccagccgtcttcacgcttgtctctgtgtttgtggactggattcacaaggtcatgagactgggttaggcccagccttgacgccatatgctttggggaggacaaaacttgtaagtacagtcaaggacaagacttgtactcaaagttgagatttaataaaattaatatttttactacttcaaaaaaaaaaaaaaaaaaaaaaagaaaaaaaaaaaaaa

SEQ ID NO: 64 - DNA, 60 bp, Homo sapiens
tgaaaggaattagaatccccaaccgagtatgcgcaaggtcgcgctggccagccgtcttca

SEQ ID NO: 65 - DNA, 5740 bp, Homo sapiens
cgccgccgccgcacgccgcctgcctcctgcacgccgccgccgcgcctagcgcccgggcccgcgacaccgcccgctaagcgccgggccgagttcacgcagccgcggtctggcggctccgcggcggcggcgggtgcgggcggcctggccggtgccggttaaagggacgagttgcaaacacttcaggaagtgacaagtcgatttcctcctccccgggagtcgctcgtacaaagcgctcggcgccggcaggcgagcgtgcgcgcggcggacgcgcggcgggcaccccggacgacttggcgagcgctggcggtgacggcgcggggtccgcgcccggagcgccccgccgcgcacaggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgtggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcagccgctcccagccgtgtgtccttaacgacaagaaggtcggtgttaaaaggcggcgccctgaagaagtgcaagagcagaggccttctctagaccttgccaagatggcacagaactgtcagaccttcagcagcctcagctgcctgagcgcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtctctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccgtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagccggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttagggagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggccatctgcctgctcatggggtcctaaagcgcgggctaagcctgcaggaaagccggggcggtggggggggcttagtgccacatgcaccccactcattccaaagccaccaaactgccaggggctgccgtccacccgtggggcccaggggctggggccacagccttgccattttcgttgccataccctcttgccttactcgcggtggaggccggatttgcacgggcagacgtgcacctgggcccgtggggagcttgttctgaccagacgtacagattttcattctcagaaagccttacttttcaaccaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagattttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagggtctgcccgcccctgcagcctggcctccccgcacaggctgtggcttgcactccagccgctctagtctctcaggaatttgcttgttacttgtactgtgtaaataaagcttcctggttcaataccc

SEQ ID NO: 66 - DNA, 60 bp, Homo sapiens
tctctcaggaatttgcttgttacttgtactgtgtaaataaagcttcctggttcaataccc

SEQ ID NO: 67 - DNA, 5056 bp, Homo sapiens
gacggccttcccactgggaacacaaacttgctggcgggaagagcccggaaagaaacctgtggatctcccttcgagatcatccaaagagaagaaaggtaagtagagctttgcatttacattttgaaaaattacaaagatgaactcatttttttcctgagagcaataactatttggcaatgcacagccctggcaaaaggccgtcgaatgtgtttgaaggtgtctgttgttgtttttgttcaggacgcttgcgttttctatttcaggtgacctcacattcgtgccccttagcagcactctgcagaaatgcctcctcagctgcaaaacggcctgaacctctcggccaaagttgtccagggaagcctggacagcctgccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactggtaagctcggcccccgctgcctgtcccagcaccctgcaggcagggctcccctgcgtctcctgggagttggtggagaaaggtgaatgaaggccttcgggtagtttcagactcttgagaagatgaatgcaatggtcagaaccatacagacttgaattttgtgacattagtgggccagcccaagctttaaatgaggtgtgtgcacaaaagctctgccaactagattcctgattaaaaaaaaggcagcccctctcctacagaccagctcctagtggagtaaatgtccacctggccatgtcttagacggtctgtgtgttcacactgatggactgttgttagcgtgctcagcactctgctaggcatggaaagccacggtactgaaggagatggttcgctgcccgtggtgcttggctgaaaggaagcctgtgatttttgcagctggttggctctcactgaccccagggatgtggccaggatcgaaagcaagacggttatcgtcacccaagagcaaagagacacagtgcccatccccaaaacaggcctcagccagctcggtcgctggatgtcagaggaggattttgagaaagcgttcaatgccaggttcccagggtgcatgaaaggtgagcggaacattgatttgattgggtaaaacagcagagagccttttcttatttacatctatcctaatggtaattcaaacaataatggaagctcccaccacctcagatgtctttcagttccatacatgaagttggcaatgtattgaaaatgcacatccctcttctgcttttacagactgtcttatacaaacgtgaaaactagttccatgcatatgggttttaaatagcttggtgggacccaattgcacatttatgaaaactctttaatttcagcaggctgttcactttccagtggcctcttctaacccagggggctggtgaccagcagggtgtggtggtgttagtggaacaccgtgaaaatgggtctacctgggaaaaaaatgctggtcgtgttcgaagtccaaggtcatttctcaccagtgcccacccatcgcaccctgtaggtcgcaccatgtacgtcatcccattcagcatggggccgctgggctcacctctgtcgaagatcggcatcgagctgacggattcgccctacgtggtggccagcatgcggatcatgacgcggatgggcacgcccgtcctggaagcactgggcgatggggagtttgtcaaatgcctccattctgtggggtgccctctgcctttacaaagtaagtgtattatttcagaatcaaaagtcaaaataaaaaagaaagctgaacgcaaaccccagtgagtgcctcggggacccccaaccagggccctggcgcactgacttgggaggggtccttgttcacagagcctttggtcaacaactggccctgcaacccggagctgacgctcatcgcccacctgcctgaccgcagagagatcatctcctttggcagtgggtacggcgggaactcgctgctcgggaagaagtgctttgctctcaggatggccagccggctggccaaggaggaagggtggctggcagagcacatgctggtgagcctgcaggaagccctgatgtgcagatgagaggcctggggggtggcagaaacaaacagcattacagttcccacccgtcagcacacctctctgagcgtgcaggttcccggacagatcgggaaaccccaccagtaatgattagtttacacatatacatcgcttttgaaggcccccaaacaccaggggaccatagagatcctttggacttcatgattctgggagtgtttgtttgcactgatacctgaagaaatagatcttgagggcctacattccaacctctgggctgaagtaccaacctcggggagaaggaaacaaagatcacaataaagaatcttgtccccaacagattctgggtataaccaaccctgagggtgagaagaagtacctggcggccgcatttcccagcgcctgcgggaagaccaacctggccatgatgaaccccagcctccccgggtggaaggttgagtgcgtcggggatgacattgcctggatgaagtttgacgcacaaggtgactcttttagacccaactcttggtaacgattggactcaagcgaatcgttggccttcgaagcatgtcacattctcctcagtccagtgtttggatttttaaactctgttagtcctgagttggccaagccttagaaatatggatcctgtaagaattcttcaacttaatattcaatctggattgaaactgggccatatgttgctgtttgtttacatacatacatttgtttaaatggtattggtggaaaattgtggaggaagcaagagtcgtaaacgtatcaaagttgcatatgatgcttggatgaaaagagataaatgcatattctagggagggaaaaaagatttgagaagttggcatagaaattagtccggcaatatataagagtatatgttctgctttgcctggcactcactactgcttctctggtttaaaactctccaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggcgtcaccatcacgtcctggaagaataaggagtggagctcagaggatggtgtgtccctgccagaggccttggtgtgccgggctgcagggactgcctgtttgagccaggcactcacgagcctttctctgtcttataggggaaccttgtgcccaccccaactcgaggttctgcacccctgccagccagtgccccatcattgatgctgcctgggagtctccggaaggtgttcccattgaaggcattatctttggaggccgtagacctgctggtgaggctctccttcatttaggctgggaacatgggtgtgctgggtaccgaagggcatctgtgaaatctctccttttccatgaccttgtcagagggtgcccaggggcttcctttcttgagcttccttcccaaagatccagaataattggcaagttcaaatgtagaaccaacccttctggtcacctggaacctttctgaatccctgatctattgtagcttgatcaaattttactttttactttgtggcctcagtcatgtaactttgagttagtagttttctgcaatttagcttggtgaacgcaaaactagctcgattacaaagttattgtcttgccgtgtctttccgtgttgtgaataacaccactggttgtggagtctgaatttcaaagcctctgatgaacatttctctttttttcctgctaaaggtgtccctctagtctatgaagctctcagctggcaacatggagtctttgtgggggcggccatgagatcagaggccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaagctcacgcccataggctacatccccaaggaggatgccctgaacctgaaaggcctggggcacatcaacatgatggagcttttcagcatctccaaggaattctgggagaaggaggtggaagacatcgagaagtatcgggaggatcaagtcaatgccgacctcccctgtgaaatcgagagagagatccttgccttgaagcaaagaataagccagatgtaatcagggcctgagtgctttacctttaaaatcattccctttcccatccataaggtgcagtaggagcaagagagggcaagtgttcccaaattgacgccaccataataatcatcaccacaccgggagcagatctgaaaggcacactttgatttttttaaggataagaaccacagaacactgggtagtagctaatgaaattgagaagggaaatcttagcatgcctccaaaaattcacatccaatgcatagtttgttcaaatttaaggttactcaggcattgatcttttcagtgttttttcactttagctatgtggattagctagaatgcacaccaaaaaaatacttgagctgtatatatatatgtgtgtgtgtgtgtgtgtgtgtgtgtgcatgtatgtgcacatgtgtctgtgtggtatatttgtgtatgtgtatttgtatgtactgttattgaaaatatatttaatacctttggaaaaatcttgggcaagatgacctactagtttttctttgaaaaaaagttgctttgttattaatattgtgcttaaattatttttataaaaaaaaaaaaaaaaaaaca

SEQ ID NO: 68 - DNA, 60 bp, Homo sapiens
ggcattgatcttttcagtgttttttcactttagctatgtggattagctagaatgcacacc

SEQ ID NO: 69 - DNA, 5123 bp, Homo sapiens
aacaagatgagctgatagggttcccaggctgcctggagttacataacccattgtgcttccaggacagctcacaatcttaggatttgccctaacaagcaaactcagaaaactgctgaggaaggcacgggagggtggctgtgcgaggtactgccggggctgagctctcatggaggctctctctgttctctgaagtgcctttggagtttatgtctgcacatggcattggtttttcaattcgggcagcccgtcagggctcagcctctgccaggactctgccacggcaagctcattcggacaaacgcctgtgatgtgtgcaacagcaccgatcttccggaagtcgagatcattagcctgctggaggagcagctgccccattataagttaagagccgacaccatctacggttatgaccacgacgactggctccatacacctctcatttctccagatgccaacattgacctcacaaccgagcaaattgaagagacgttaaaatacttccttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcactgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttccgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcagcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactcctacacgcccaagatggctgtgatcccctctactccgccgaactcgcctatgcagacacccacatcctccccaccctcctttgagttcaagtgcacgagccctccctacgacaatttcctggcttccaagccagccagctccatcctgagggaagtgagagaaaagaacgtccgcagcagcgagagccagaccgacgtgtccgtctccaacctcaacctcgtggacaaagtcaggaggtttggggtggccaaagtggtgaactcagggcgagcccatgtccccaccttgactgaggagcagggacccctcctctgtgggcccccggggccagcaccagcccttgttcccagaggcctggtacctgagggcctgcccctcagatgccccactgtcaccagtgccatcggtgggctgcagctcaatagtggcatccggcggaatcgcagcttccccaccatggtgggatctagcatgcagatgaaagctcctgtgactctcacctcgggcatcttgatgggtgctaagctctccaaacaaactagcttacggtgaggactggaggggggccggttgccctagaggagacccacgttctcctctcttgctcccacctccctctcttccccccacagtgcactccctccctctgcccttctctgtccaccccctcctaagctagacaaatcaacctcgtgcctaatggaggaagtgtggaaactttgtaaaatgtgtacataggacttggagaccttgtgtccgccctgctctttcttccgatcccacaggaagtgcccctgcactgtcatcactctcacgaggacgtcacctgtgctaacctgggggaaggtggggtcctttcttctttccttttgagaagcactgaaactcccaagtgtgttcttatcccatggataggaaaccagtgaattccgtggctggcacaccacgagctgtcacgcggcacgggtcataacacatctgggtgtcatcggacacctcacctcgcccaccctgtaggagcgtaaggagcctccatcctcagccacgtgcagctgacgtggctttcctgatcggagggcttttcttttatgggtggcccagcttcttcaagaccttcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagcccctctgtgttctgtgtgatttgttttatttttccttttttttacatatatatgcagggaagtaatggtactggtagtgtatgttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccatgcggtctttgattgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttccagtttcagtcatagtgtgtctgtggcattccagtccaaccatgtgacttatttattctaatttgagggctgcactgtacaccatggtgtcctgtgacaccgtgttccagacatttatggaaggaaaacatcccatataaatgaaactgtcatgctgtgtcctccccggcagcagaagatgtgtccttccattgagtgagggtaaccttatgtccaccaaggatactttgagaaagcccctaaggaacaagcctcagtcccacggtttcagactatttattctctgaacacaagagtattggttaattatgttctcagctctccctgctgttgtatgtgtgcattcactgcaagtaacttatatctttttatttgaatgtattttaaagcagtagatagaataacaaaggaatatgaaaaccatggactgaatggaccattttatgtattcagagagagaagccactcatcattgccagaaataccatgtaaaaattggcagttcagaggttgcaatacttagtatagtaaataaataaacggtcaacattgtgcaaccactaccaaaaagtgtgttgtaatgcatcaaaaatcaacacaattttattcactaatgagtatcaataaaataagttcaaatgatggaaaccacaaaaaaa

SEQ ID NO: 70 - DNA, 60 bp, Homo sapiens
gtcaacattgtgcaaccactaccaaaaagtgtgttgtaatgcatcaaaaatcaacacaat

SEQ ID NO: 71 - DNA, 4456 bp, Homo sapiens
gcgccttcctgttagtccgagctgggagaagttcactccgatcagctgatcccaactgacaacaggagaggaggaagcccgggaggcaacgaaggaggagggtggcggagatggagatgaggatggatctgccggtgtcctgaggaatagcctctgcccccactggcgccctgcggccccccgacgccgccttgctgcggccgagcttctcagtggtatcccctgaaatactgacttcaggtcgaattatattgaaaagctcctgaccactttctttcattaccaaaactttgtagctgatgtccaaccgatgaacccaccaccgtgaacccatcagacctctctcagatagccataaaagacccttccaagtcaattttgaccacatctttgcttgcactttatggaggatgaaaccatcaaaccaaatcaacgttgctgctaatacaagagtcttagaggcagcaaattaaaaatttgaacatttgtttgtgaagaactataacaggacatgaaaggtgttcttttttaaagtgttcagaaccctgtggaagtttcgtgcagtcttcagactcaaatcttcgtcttcacccccggggcaagctcagtgactattatatggtgggtgtgtttccttaccagcgtgagtatgagtgcccagacttccccagcagagaagggcctgaatccggggctgatgtgccaggaaagttacgcttgcagcgggactgatgaagctatctttgagtgtgatgagtgctgcagtctgcagtgtctccgctgcgaggaggagctccatcggcaggagcgcctgagaaaccatgagcggataagactcaaacctggccatgtcccttactgtgacctctgcaagggtctcagtgggcatttaccaggtgttaggcagagggcaatagtgaggtgccagacctgcaaaattaacttgtgcctggagtgccagaagaggactcattctgggggtaacaaaaggagacaccctgttactgtgtacaatgtcagtaatctccaggagtcactggaggcagaagagatggatgaggagaccaagaggaagaagatgactgagaaggttgtgagtttcctcctagtagacgaaaatgaagaaattcaggtaacaaatgaagaagactttattagaaaattggactgcaaacctgatcagcatctgaaagtggtttccatttttggaaatactggtgatggaaagtctcatactctcaaccacactttcttttatggtcgtgaagtctttaaaacctccccgacccaggagtcctgcactgtgggagtgtgggcagcctatgacccagttcacaaagtagcagtgatcgatacggaagggctcctgggggccaccgtgaatctaagccagagaacacggctgctgcttaaggtcctggccatctcagacctcgtcatctatcgaactcatgcagaccggctgcataacgacctcttcaaattccttggggatgcctcagaagcttatctgaagcacttcaccaaggagctcaaggccaccactgctcgctgtggcctggatgtccctttatccacactgggccctgcagttatcatcttccatgagaccgtgcacacccagctactgggctctgatcatccctcagaggtgccagagaagctcatccaggaccggttccggaagctgggccgtttccctgaagcctttagttccattcactacaagggaacgaggacttacaaccctcccacggacttttctgggcttcggcgtgctttggagcagctactagagaataacaccacccgttctccccggcacccgggagtcatcttcaaagccctgaaggcactaagtgaccgcttcagcggtgagatccccgatgaccagatggcgcacagctccttttttccagatgagtatttcacctgctcctccttgtgcctcagctgtggggttggatgtaagaaaagcatgaatcatgggaaggaaggagtgcctcatgaagccaagagccgctgcagatactcccaccagtatgacaaccgagtgtatacctgcaaggcctgctatgagagaggcgaggaagtcagtgtagtgcccaaaacatctgcttccactgactccccctggatgggtctcgcaaaatatgcctggtctgggtatgtgatcgaatgtcctaactgtggcgtggtctatcgtagtcggcagtactggtttggaaaccaagatcctgtggatacggtggtgcggacagagattgtgcatgtgtggcctggaactgatgggtttctgaaggacaacaacaatgctgcccagcgcctgttggacgggatgaacttcatggctcagtcggtgtccgagcttagccttggacccaccaaggctgtgacttcctggctgacagaccagatcgcccctgcctactggaggcccaactcccagattctgagctgcaacaagtgtgcgacgtcctttaaagataacgacactaagcatcactgccgagcctgtggggagggcttctgtgacagctgttcatcaaagactcggccagtgcctgagcggggctggggccctgcgccagtgcgggtctgtgacaactgctacgaagccaggaacgtccagttagctgttaccgaggcacaagtggacgatgaaggtggaacgctcattgctcggaaggtgggcgaggccgtgcagaacactctgggagccgtggtgacagccattgacataccactaggtctggtaaaggacgcggccaggcctgcgtactgggtgcctgaccacgaaatcctccactgccacaactgccggaaggagttcagcatcaagctctccaagcaccactgccgggcctgcggacagggcttctgtgatgagtgctcccatgaccgccgggctgttccttctcgtggctgggaccatcccgtccgagtctgcttcaactgcaataaaaagcccggtgacctttaaccccagccccctctccgagtccttcacaattccttaggttctcagggttagaaacagtcttgcgaggtaggccctcctcccagtcacctgctgtggtgtgtgtcctctcctctccgcatccagggccactttccctcagtgggggtgagcctggcggcaggcccgaaggtgtggacccctcagggcaggggaccttgcaacttatcgcaaaggggaatgaacctgaatccgttgcatttatttcagttaaaaataatgaatatatatgtgtatatctctctctcatatatacatatgaaaggcactcggggcgtatcgaggctgctgctggctgtgaagacttcgcacagtctcctccgcacagggtgaggtggcagtggcagcacgtcttcctcatgagccgagccaggtccatggccaccacgtggctggccccttcctctgctgctcttggagccttggaagcctctcctgtccttggctcttccctccatgcctgtcagctgcctggggagtgagcctccctggtccttcctgcctgaaacagcctgaagggaattctccctaggtctcctgggagtcgagtcccaattcttggcttaagcctgttttagtcagagaccacccaacttagcgtgcaggtcaccggagtgggtggagggtcagaggtcgggtcttcggccctgagaagtagaaatgcaggggccgtgctgtccctggtcccccagggaacagcaaggaaggaactgagccttctccagcagggcttcctgtcccgatgcttgtgtctccactcggctttcccaaaaggcggcacccagctcctcaatcgaagcatctgcctcccacccctcggccccctcaagcccaccatctgcttctgagtgtcgcactaggattttcattgcttattttaaagtgtcttaatcctttgttcccagacacacaacccctctagctctcggaggggcgatcatgagaaaccttccagggaaactgagcacaggatgaactgttagttgtttttaaaagtctatataaatatttcaacagatcgtaaagaaaaaatttatctctttggtccttgcaagagaagtcaaaggaacttttgtttctcctcaagagcctggacatctctgtctgtcatgactggaaagggcccgttgtgctgaaatcctatcatcatggtggatttgatcttcagtggccaaacacgaattaaagtataattcttaactgaactggtgggtgggttgagctttagggaagtatatggcggtcattcctggtgcgcctatcggtgtgacatgagccctggagtgtgtcgtccctctcagccctgctcctcctgcctcctggggtccagtgactgggaccctactctagaactgtgtaccatccaattcgccatcataaaggaatcttcctgcaaaaaaaaaaaaaaaaaaaaaaaaaaaaaaaaaaaaaaaaaaa

SEQ ID NO: 72 - DNA, 60 bp, Homo sapiens
actgggaccctactctagaactgtgtaccatccaattcgccatcataaaggaatcttcct

SEQ ID NO: 73 - DNA, 1896 bp, Homo sapiens
  misc_feature 790, 1160, 1161, 1162, 1184, 1222, 1303, 1329, 1333, 1334,1353, 1373, 1433, 1435, 1442, 1450, 1459, 1496, 1497, 1526,1527, 1571, 1573, 1593, 1637, 1656, 1787, 1789, 1796, 1798,1812, 1881, 1887, 1896: n = A,T,C or G
  misc_feature 790, 1160, 1161, 1162, 1184, 1222, 1303, 1329, 1333, 1334,1353, 1373, 1433, 1435, 1442, 1450, 1459, 1496, 1497, 1526,1527, 1571, 1573, 1593, 1637, 1656, 1787, 1789, 1796, 1798,1812, 1881, 1887, 1896: n = A,T,C or G
cctcggctccagcgccatggcgccctccaggaagttcttcgttgggggaaactggaagatgaacgggcggaagcagagtctgggggagctcatcggcactctgaacgcggccaaggtgccggccgacaccgaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctggggcactcagagagaaggccatgtctttggggagtcatatgagctgactgggcacacacgtggccatgctctgcgcccggcactccgagtaatcccctgccttggggagaccccccaccacagggacgatgttatcccccaaaaagcccgccacgtcacctgacctcttaccactcacacccccccactgccctgtcctccccaccctctcacccctcctaccccccccgccgtcaccccctccagcccccccaccctatcccacctgtaccttctgccgcccagtccacaactctaccggtcttgcctctcccgtttttcctcaggtatccgaaatctccgcgcataggggtcatctaaccgcttcgtgacctacctcttcaccctccacgcaccatcgcccactccggcccctctcgaggggaaacgtctattcacgctctctttgcctatcctaccccctaagacatcccacttcttatccacgcggtncagtcagcggtcgtgccctcatgtagatagtcccccgcccgtgctggacacgcctgccaaacagtcatttaccatccagcgctacagcccacataccgctccacgcgagtatacagcccgcctccccgtcctcctccctctcacacaatgacgcgtggtcaccccccatacgccttccacccacaaacctgtcacccatcctattcctgttcctgcacaattgggtaaaagatcaaaaccccctttaattttaaacctgcaggcggccccccagaatccggtggcacggtcatcccctgcagtaaagtcacctcttgacctgaaatacaccggtaaagggatgggactccttaaggcaacgaagctactnnnttgaagtgggccacatgcaacncaaagagggttattccatggagtgaccgacaactgtangaccgttaaatactaatggttgggaatgttcacgcgaactttccacatgacatcatccccgtattcaaccacccggtcccnccagaaggaccacactgcaatatttntaanntttatttttaatggccccntttaattggcatctccgccncgccccattccctggttaattgccgtccgatccgtcctggcgatgcgctcccaccccccncntaaatanaatgacgnctagctgcntgcacagcacctgtctctcgccccgctcgccatccannatcgccttaactagcactatagtaatatnnttcgcttgccacatatatacacacccattgtcacatattccacntnctaaccacatctcttaaccnacggccggcagcctgcatgcaagccagccgtgtataggttgctncccatcattgccctcagtntcctttaccatcccctctgctaccctcctaccgacggttgcttggtcgaacccacatctcgcctttcgattctcctcggcccactcacgcttcacattgatgttgtgtgatatcgccgtcatacctcccgncnggcgcgntnggtcgtacttctcntgtaccatggcgcccgctcctgtaatgtcccatccaactacctacacctttgtgctgcacctgatactntgctcnattagcacn

SEQ ID NO: 74 - DNA, 1812 bp, Homo sapiens
agaacagccgccgctccggcgggctgctcgctgcatctctgggcgtctttggctcgccacgctgggcagtgcctgcctgcgcctttcgcaacctcctcggccctgcgtggtctcgagctgggtgagcgagcgggcgggctggtaggctggcctgggctgcgaccggcggctacgactattctttggccgggtcggtgcgagtggtcggctgggcagagtgcacgctgcttggcgccgcaggctgatcccgccgtccactcccgggagcagtgatgttgggcaactctgcgccggggcctgcgacccgcgaggcgggctcggcgctgctagcattgcagcagacggcgctccaagaggaccaggagaatatcaacccggaaaaggcagcgcccgtccaacaaccgcggacccgggccgcgctggcggtactgaagtccgggaacccgcggggtctagcgcagcagcagaggccgaagacgagacgggttgcaccccttaaggatcttcctgtaaatgatgagcatgtcaccgttcctccttggaaagcaaacagtaaacagcctgcgttcaccattcatgtggatgaagcagaaaaagaagctcagaagaagccagctgaatctcaaaaaatagagcgtgaagatgccctggcttttaattcagccattagtttacctggacccagaaaaccattggtccctcttgattatccaatggatggtagttttgagtcaccacatactatggacatgtcaattatattagaagatgaaaagccagtgagtgttaatgaagtaccagactaccatgaggatattcacacataccttagggaaatggaggttaaatgtaaacctaaagtgggttacatgaagaaacagccagacatcactaacagtatgagagctatcctcgtggactggttagttgaagtaggagaagaatataaactacagaatgagaccctgcatttggctgtgaactacattgataggttcctgtcttccatgtcagtgctgagaggaaaacttcagcttgtgggcactgctgctatgctgttagcctcaaagtttgaagaaatataccccccagaagtagcagagtttgtgtacattacagatgatacctacaccaagaaacaagttctgagaatggagcatctagttttgaaagtccttacttttgacttagctgctccaacagtaaatcagtttcttacccaatactttctgcatcagcagcctgcaaactgcaaagttgaaagtttagcaatgtttttgggagaattaagtttgatagatgctgacccatacctcaagtatttgccatcagttattgctggagctgcctttcatttagcactctacacagtcacgggacaaagctggcctgaatcattaatacgaaagactggatataccctggaaagtcttaagccttgtctcatggaccttcaccagacctacctcaaagcaccacagcatgcacaacagtcaataagagaaaagtacaaaaattcaaagtatcatggtgtttctctcctcaacccaccagagacactaaatctgtaacaatgaaagactgcctttgttttctaagatgtaaatcactcaaagtatatggtgtacagtttttaacttaggttttaattttacaatcatttctgaatacagaagttgtggccaagtacaaattatggtatctattactttttaaatggttttaatttgtatatcttttgtatatgtatctgtcttagatatttggctaattttaagtggttttgttaaagtattaatgatgccagctgtc

SEQ ID NO: 75 - DNA, 60 bp, Homo sapiens
gcacaacagtcaataagagaaaagtacaaaaattcaaagtatcatggtgtttctctcctc

SEQ ID NO: 76 - DNA, 3587 bp, Homo sapiens
aggggtgctgacgtttgcgccgcgcacgactatgtccgccatgttagtgtctgacgcaggcgccattacaggagccgtctctcttgaggcgaccgtgtccgcataagttgtcagtccccagcagtgtttgggagccttaacaggcttgctaagtgcctgagattaaaggcgaagaggaagaagagcaagaagggcaacccggtgtttaacacacggctttcaggcgctctcaggtggcgccaagttcagtttcgacagggatatgcatccgggagagaatttttcagcccccgcccccactggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgtccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtggtccagagtgccaagtgggtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacatcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggttttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagaaaaaaaaaaaaaaaa

SEQ ID NO: 77 - DNA, 60 bp, Homo sapiens
ctgattcattgttggtatgtacaaactgttgacttgtaaaatcaataaagtcttagttgg

SEQ ID NO: 78 - DNA, 2377 bp, Homo sapiens
acccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaaaaaaaaaaaaaaaaaaaa

SEQ ID NO: 79 - DNA, 60 bp, Homo sapiens
gttacacagaatttcaatcctagtatatagtacctagtattataggtactataaacccta

SEQ ID NO: 80 - DNA, 2178 bp, Homo sapiens
cgtttgaatcatttccttgggggtcttccctgatgccctgtgctgctcccagagcctgggtcaggttgtgggttgttgtgtgtgcatcataagttggttctgggctcctgggcatctgggcagagccatctgtgtagccagcagtgtcttgtgcccatcatgggcccttggtagacagggaaagtggcagtgggtagaggctggcttctgggtaaggtgtcgaagaggctgtgggctgggtcggggcggggtgtgaagggggcatgcagggggcttggcatccgctgtggcaggctgcagtagacgagacccccccccagctcccagttcagatagtgacgtgtaggggtatcctgggggtgcatgtggcctggactgggcatgggcacctgggatggtctgggttctcagggagctgttctgaagagtggtcacctgcagggccatctccccttggggctgcctgtgcctggggagttggggtggaggcgtccattgcaggccgtggctctgtctcctgtgccctccaggcttcagtcatggggatgcaggtgggcactcctgcatcaatcatggggatgcatggccacggcccccagtgggctcccttctggcaactgccccactttctagccttctgctgccccccactttcagataggctggctctatgtgttgggttcccttaggaaagactgtgccccctgggccttgtgccctgatatctgaccctgggcttctgacttcacggccagggtcagaatcaaggggatcagggttgggcttgagtgcagccctgggatacagctggggcctgctttgccagctctgcttctctgcatttctggaggtgggggtctgtgtgccaagtgatcttgaacacagctcaggagctcctcgtggagatggccttacggtcagggaacaggtgcccattcctatttaggatggtcctggttttaagtgaatatggaggattttcaaagaggtttgaataaaactcaggcgccgtggtactttgtctaagcctggttctccaaccccagactgtccccgtgttgtctgaagcagacccctcaggttggtgagcagggtgctctgtggccgagggctgggtgggctggcctttgcagtcatctcaccatcttcacgagcttctctctcttcagtcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaaggtgacgtggtgccatgggttggggggcttctttgcagactcactctgcatctgactatacttccaggcgggtgctttttctgtctgccagataaacattccagggtgctgtggccgcctcacgtatccagagtgatgcagctccctggggacacaggtgcttcctggggagccctgagcacttgtcagtgttgctggcctcagtccaattgggcaggcattggagtccgggcactgcctggagctcaccagaaggtgctttatgatggtcctcggtttgtctctcagagggcttggtcacctctgccatgaggctggactgcagctgtggtggcaagtgaccagatgtcactgagcagcctgaccatggtctaggcagtgcttgagtgcatccacctggcttcctttcgtcactgaatttcaagaagacagactccaggaggcggcttggccaggcaggagtctgtcccgagggcgggcaagccgctgtgggtgggtgacggcacttgggaccagcctggcgagggccatgtgcttgaatgcaccgtgcttctgttttctcactgtgctgcttgtgtttttagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaaattttaccctgcccctctttttcggtttgtttttattctttcatttttacaagggacgttatataaagaactgaactc

SEQ ID NO: 81 - DNA, 60 bp, Homo sapiens
ttttcggtttgtttttattctttcatttttacaagggacgttatataaagaactgaactc

SEQ ID NO: 82 - DNA, 1938 bp, Homo sapiens
gatttggcgggagtcttgaccgccgccgggctcttggtacctcagcgcgagcgccaggcgtccggccgccgtggctatgttcgtgtccgatttccgcaaagagttctacgaggtggtccagagccagagggtccttctcttcgtggcctcggacgtggatgctctgtgtgcgtgcaagatccttcaggccttgttccagtgtgaccacgtgcaatatacgctggttccagtttctgggtggcaagaacttgaaactgcatttcttgagcataaagaacagtttcattattttattctcataaactgtggagctaatgtagacctattggatattcttcaacctgatgaagacactatattctttgtgtgtgacacccataggccagtcaatgtcgtcaatgtatacaacgatacccagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggagatagtggagcaaaccatgcggaggaggcagcggcgagagtgggaggcccggagaagagacatcctctttgactacgagcagtatgaatatcatgggacatcgtcagccatggtgatgtttgagctggcttggatgctgtccaaggacctgaatgacatgctgtggtgggccatcgttggactaacagaccagtgggtgcaagacaagatcactcaaatgaaatacgtgactgatgttggtgtcctgcagcgccacgtttcccgccacaaccaccggaacgaggatgaggagaacacactctccgtggactgcacacggatctcctttgagtatgacctccgcctggtgctctaccagcactggtccctccatgacagcctgtgcaacaccagctataccgcagccaggttcaagctgtggtctgtgcatggacagaagcggctccaggagttccttgcagacatgggtcttcccctgaagcaggtgaagcagaagttccaggccatggacatctccttgaaggagaatttgcgggaaatgattgaagagtctgcaaataaatttgggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggagtaacctggacaagctgtaccatggcctggaactcgccaagaagcagctgcgagccacccagcagaccattgccagctgcctttgcaccaacctcgtcatctcccaggggcctttcctgtactgctctctcatggagggcactccagatgtcatgctgttctctaggccggcatccctaagcctgctcagcaaacacctgctcaagtcctttgtgtgttcgacaaagaaccggcgctgcaaactgctgcccctggtgatggctgcccccctgagcatggagcatggcacagtgaccgtggtgggcatccccccagagaccgacagctcggacaggaagaacttttttgggagggcgtttgagaaggcagcggaaagcaccagctcccggatgctgcacaaccattttgacctctcagtaattgagctgaaagctgaggatcggagcaagtttctggacgcacttatttccctcctgtcctaggaatttgattcttccagaatgaccttcttatttatgtaactggctttcatttagattgtaagttatggacatgatttgagatgtagaagccattttttattaaataaaatgcttattttaggctccgtccccaaaaaaaaaaaaaaaaaaaaaaaaaaaaa

SEQ ID NO: 83 - DNA, 60 bp, Homo sapiens
ctgtcctaggaatttgattcttccagaatgaccttcttatttatgtaactggctttcatt

SEQ ID NO: 84 - DNA, 3107 bp, Homo sapiens
cggtgagtcttggcggctgttaacgcgcgctttgggaacaggaaggttgagagagaggtgctggggtctgcgtctatctctgtcgctcttttcagcccctcctggtattcccctcctaacctgggttttttacacgcccgcgtggcttcctgctcgacctccctgagtctgatcctggtttccacctccagccctgggaaatttcctttctccagactcgccctccccacccgggcctcggactttcaccccagcttctctctcctggccagtgattacccacccccaatcccaccccgccccgccgcgcaactacctcctcccttcacccggactgggaccatcatccccactccactccgcccagtctgggactccacctgcctcctccccaatcccacactaatctctgcttggtctcttcctctttggcctaatctctcgtctcggcttattggggacggccactctcacagtttggttccaaacaccagttcctggatggattcccgccatccatgccccctctttaattagccggtcctctcagtaatgtagcagccccctctacagattagaccctggtcctacactcttagccgctgcctgcttttgacctttggctcatgggtacttgacgttttaaactcctaggcccaggatgaggaggagcttggctcccagccagctggccaagagaaaacctgaaggcaggtcctgtgatgatgaagactggcaacctggcctagtgactcctaggaaacggaaatccagcagtgagacccagatccaggagtgtttcctgtctccttttcggaaacctttgagtcagctaaccaatcaaccaccttgtctggacagcagtcagcatgaagcatttattcgaagcattttgtcaaagcctttcaaagtccccattccaaattatcaaggtcctctgggctctcgagcattgggcctgaaaagggctggggtccgccgggccctccatgaccccctggaaaaagatgccttggttctgtatgagcctcccccgctgagcgctcatgaccagctgaagcttgacaaggagaaactccctgtccatgtggttgttgaccctattctcagtaaggttttgcggcctcatcagagagagggagtgaaattcctgtgggagtgtgtcaccagtcggcgcatccctggcagccatggctgcatcatggctgatgagatgggcctaggaaagacgctgcagtgcatcacattgatgtggacacttttacgccagagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctggaaggattcatgaaccagcgtggagccagggtgtcttctcccatcctcatcatttcctatgagaccttccgccttcatgttggagtcctccagaaaggaagtgttggtctggtcatatgtgacgagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctagggactgcccatgaattcaagaagcattttgaattgccaattttgaagggtcgagacgctgctgctagtgaggcagacaggcagctaggagaggagcggctgcgggagctcaccagcattgtgaatagatgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaatcatccagctctaatctatgataagtgtgtggaagaggaggatggctttgtgggtgccttggacctcttccctcctggttacagctctaaggccctggagccccagctgtcaggtaagatgctggtcctggattatattctggcggtgacccgaagccgtagcagtgacaaagtagtgctggtgtcgaattacacccagactttggatctctttgagaagctgtgccgtgcccgaaggtacttatacgtccgcctggatggcacgatgtccattaagaagcgagccaaggttgtagaacgcttcaatagtccatcgagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggttgcactgccgacgttgtgtcaacagccgtcagatccggccaccccctgatggttctgactgcacttcagacctggcagggtggaaccactgcactgataagtgggggctccgggatgaggtactccaggctgcctgggatgctgcctccactgctatcaccttcgtcttccaccagcattctcatgaggaacagcggggcctccgctgataaccagctggtctgggtgtagctcttagaggaaggagatagggaaaaggggctccttgctccacagggccctgttgaattttgttctctgggagaaaatcatcaagaagggctgcatgatgtttgcccaaaatttattttataagaaaaacttttttggttaaaaaaaagaataaaggtatgaaagggttaaaaaaaaaaa

SEQ ID NO: 85 - DNA, 60 bp, Homo sapiens
acagggccctgttgaattttgttctctgggagaaaatcatcaagaagggctgcatgatgt

SEQ ID NO: 86 - DNA, 2615 bp, Homo sapiens
gttgaacattttttatgtggaacattgattgatttttgtacgttgaactatccttgcattccaggaataaatcctgcttggtcagggtgtataatttttttattatactcctgaattggttttgctggcattttgttgaggacttttccaacgatgcttatcagggatattggcatgtcatttttcttgtggtgtctttgtctggctttgatatgagggtaatgctggcctcttaggatgagtgaggaaatgttcttcaatttgtccaagagtttgaggagtgatactgattcttcttaatgttttgtgaatcacatgtgaagacatcaggtccaggtcttgtctttcaacttttatagtttgaagattttaggttcccagaaaagttgcaagagtagcacagagacttcctgggcctgggaccttgccacgtggtgaacatcatgtgtcactgttggacccacctgtgactgggttttgccccagaatcccacccaggacgccacgtgacatttagctgtcacttctggtgggctcctgccaggtcccgtgcttcctggaggggtggccccgtgagcatctgcatagcccctttcctctgctgggccctgggtggggtgcagccactcgggtggaccctgagggtccctgcacctgtttgccctctcttgggtgcgctcaagaccaaaaatgatgttgagcagtcctgggccccggacccacagtggtggtgcggctctggtcagtgtctcctgcgctcccaggcccctgacccacagtggcggtgcggctctggtcagtgtctcctgcactccggggcccctgacccacagtggcggtgcggctccggtcagtgtctcctgcgctcccgggcccccgacccacagtggtggtccggctccggtcagtgtctccccacacagtggctcttggtgaggggtgggcgcttgcagaggggacgggcaccacgtggtcatccccatggcaggttccgtcgtggcgacggtgttgtgggaggatggtgtgctgctgcccctgcaccccgtgagatgaatcctgcctctgggaggtacagctgggacggggcgagggacccactcagctgtccaggaagggtcccctgccctgtgcttcctccaggtgtcctggtgcgctcctgagcacggtgcccagtgggggtccccacaccctgaccctgaccctgacccacgggtgcctccccttggggactccacgcccttcgctggcattgggatggagagtgacccgttcattgcagaagggctggacctgaggctgcctgaagccacaccaagggccacagccccagcagctccagccttcacgtgccagatgccaagccctgtgctcaggaggacagggaggtgggggcagaggtggccttggtgccaccactcatgtgcctcaaggtgggcagtggctgcctctgccctggaggcctgtgagggtcagggtctgagggtctgaggtgcactatgacccgggggcactgcctggccacggctgagactcgcagagggtctgcagttcccacctgcctctcggaagctgccctgggtcggcggtcagtgaggctccgccttgggctttctattattagaaagtcattgagcaacagcagtgctgaggacgcaggcagggctgtgggcactgcaggggctgctcccggtgtccacacacgtgctgggctctgccgaggtgcgggaagcctgtgtttcacgctcaggccatcctggagcccctggtttggtccctccccacctcggggccctggcgtgcatttggggtggggggttcccatggcggcctccctcagctgcctctctccccactaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctc

SEQ ID NO: 87 - DNA, 60 bp, Homo sapiens
gtccaagcctgtggctggagctggggtctgtttacctaataaagtcccacaggtgcctca

SEQ ID NO: 88 - DNA, 1771 bp, Homo sapiens
  misc_feature 1199, 1200, 1322: n = A,T,C or G
  misc_feature 1199, 1200, 1322: n = A,T,C or G
ccccctccccccctcccccctctctcctgcccgggcaccaccaaaccgctatcccgcattccgtttcccatggggagagcggccggaaatccctcgccaatcggcgacccacgcgtccgattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggcccagcgtaacgtgaacatctttaaattcatcattcctagtgttgcaaaatacagccccgaactgccagttgccttattgtttccaatccagtggataccttgaccctacctggctcggaagacagtggcctcccccgcccacagtgtttcgcggcatagccttccctcgcgccattgcagacccgggtcaccggtaccaaactgcgtcgacggcccacatcgggcagccatcgccctcgggccccacccatttcggggcctcatgccctcccccgccgatccggcgcaacgccgcggaggcggtaccgggggtcctaacggatctcaccctggacaccgccctgaaggcctcttgccgctcccgtatggccgactacggggtccctatcatgcttggcgccacacggcgcgcaactcacccggtgcgacccgattcgcggtcccacggtgcccggagcccccaataccggagtaccatgactccgcccaacagagggtgcacaccgtgtggcactccccccacccgaatttttcgcacccccacgggcgagaccccccacacacgcaccagagtccggctggcaatccccggaccatccggtaaataaccacgggcgcggcgccgaatataaattcggccccctgcgcgcctaagagcggaagcacaaagggccggtgggcacccnnaacccccacacggaggttctagctgccccacataatccccgtttggcgcctttaccccccccccgcccgggggtggtgttggtccgcccttactcgtccggccgtggtgccccccacaccanactgggcgcttaggtgggacgacccagtggtcggtgattcaaataaagtgggttaccccacaccaaccgactgcggccgcacatcccattcaagtgcacccttccatccatatctgcacccaacagggctgaaggaagcgggtgtcccccccctactgatcctggtggtacggcagacaccccggagcggggcgcggaaccttggtcttcttaacgatcacctcaccccgcctccccacccaagccgccggccggggaggtcccactcctgggggggctgcctctcacaatccccctgagagcaacgccggcgccgtataccccccccttacagcgcggctaaagcacaccgcccccaatcgccctgtcccgcctggcgcctcttaaaaaaccctactaccaaacggggcacaagagaagatgggttccctcatccaagcatcttactt

SEQ ID NO: 89 - DNA, 60 bp, Homo sapiens
catcaactcctgaagttagaaataagaatggtttgtaaaatccacagctatatcctgatg

SEQ ID NO: 90 - DNA, 2314 bp, Homo sapiens
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctgctagccgccgtcgcctgcgcgctcaggcctctgggattagtagttttagcctcgtggatggcggggcgcctcgcgaagatggtggcgcgcgtggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttcaaaaaaaaaaaaaaaaaaaaattcctgcggccgcaaggc

SEQ ID NO: 91 - DNA, 60 bp, Homo sapiens
gtatttttaacagaagacagtgcaacaactggtctccaccagtatttgtcactttatttt

SEQ ID NO: 92 - DNA, 2835 bp, Homo sapiens
tctcatgtgttggagcacggagcccttgaccagtgaagaggcaaggccagggctgagcctaagtcacaggcagaaaaaagacgcagaaacattggaataacgctccacacgcactgcttgattctgcgctagaaaccctgttatctccgaactgttggtgttattctgagttacagcaccagctcttttataaagagggagacctgctccttctttaacagcagattcgtcaaaatacgtccaaggcaaggaaacctagaaaggcgtctgggcaggggaaagtcgatgcgagggcgggccagggacctttcgtcgcgtccccaccttggcatttcccgtggcgtgagcggccccggcatccgtgtcgaaagtgcggcggcggaacaggcgcgcaggagaggagcggcgcaggcgcagacgcgcgggcgggaagatggcggctgggttcaaaaagagaactgccgtcctgatggaagagaacttggtgaattcagaaccacaactgtcaacatcggttcaattagtaccgcagatggttctgccttagtgaagttgggaaatactacagtaatctgtggagttaaagcagtaagtctaaatatgtcctattgagatttgagttacaaagttagctttatttattagattgtaatatacacctgtaattctactcttgatttggtagttgggtgtcaatttttaatgtttaatttcccaagagctttcactatgagtgttagataatatgacccaagtttaatgactaagtgaacaattgtcaaatgtagcaaaatgaaacaacttttaaaatctgagtcaccattttaaaaaaattgttatatcatttgagacattaacagatttttggtgacatccttttagccagtgatgacatgtaatctgtgtaaatgtgtagaaaattgaaattgttgaaaagaaaaatttgagggaatactggctaccatttactgagtacttgctatgttccagacacctttttaggtgctttacagaattatccactttaatgcctataacaatcatttgttacttgtcttcacctcctgttttacagatgactttcagtaacctgtccaggtacataagactcataagtaaaacttagacataaatctgactccaaagcctgtgcttctttgactacagtctaccctgtgttatttaacctcagttgagattcttctttcgtaaacctggagtgatgtataacagtaagatttgagaacttgctccttgtcaggttttatgcctgggatttaacaggtctatctcatttggcccttattaacagtccctaggagtagacactattttcttcccatttgacaagatgaggagtttaaggtaagaggttaaataacttgcctgaagtctctcagccagtaagtatggctctgacatttgaactggcttagtaattgcagagcatttgctttttttttttttttttgagacggagtcttgctctgtcgcccaggctggagtgcagtggcacgatgtcagctcactgcaacttccgtctcctgggttgaagtgattctcctgcctcggcctcccaagtagctgggattacaggcgcccgccaccatgcctggctaatttttgtatttttagtagagacggggttttgccatcttggccaggctggtctcaaactcctgacctcaggtgatccgcccgcctctgtgtcccaaagtgctgggattaccggtgtgagccaccgcgcccagctgagcttttgctctttaccactaaagcagcagttcctaaatcttgctctatcatctggagaacaaattaagattcttggctagtagttgggggcacaaacccagttactattttttaaaagatctccaggtaatcttgccgagcagcactgtagtgtagtccactgtactgtagtgcctttttatcttgtagagctattgtgaggatcagcaccaatgtccgtagaggccctgacacaattccctaagctgatatttgatagagccttccataactgattgctaaattgtcttcataatttttcagtagcttctttcaataggaaacatttctttgctactataggaatttgcagcaccatcaacagatgcccctgataaaggatacgttgttcctaatgtggatctaccacccctgtgttcatcgagattccggtctggacctcctggagaagaggcccaagtggctagccaattcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaggacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctg

SEQ ID NO: 93 - DNA, 60 bp, Homo sapiens
tggagctaaacttcaggactgtatgagccgagcagttacaagacacaaagaagttaaaaa

SEQ ID NO: 94 - DNA, 2094 bp, Homo sapiens
gatgcctgatctcatcaatctagcgggagagacaggataacctgtccgagagtatagcgccactatgactccgccggaaaaattactttaaaaatcgccaaaaattacttggagcaaagggcagtcggcggacgttcgccaaggctggccagtcggccgttttctcgacccggtgatggccgtcatctcgtgacaagaaacttaaggtcgacagaaaattcaggacccggagtcatgggtccctccggtgggtcgtggcaacagtcccccccgccaccgcccggcacccatctatctatattgtcttttgacgctgaagcgtggaggtgccccaggaaagagtttcccaagccctggctgccctcccccggcgcgctgggtcccggtgaggtctctaggtagggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaagaggtttcttttttaattgatgccaaagagttccaatattgaacatcttaagtctgttacttggattacggattgagtttggagcttactcagaggactacaggagagtatccaggaggtggataattactgtaccttcctcatggaaaaagttttatttaaagtgttatttctcattgaatactatcaaaaaggaaaaaaaaatgacctaaacttttgagatagatttggctctagtaagtatttagttatatcacttgcatatctgggagaagaaataagagactatcatcagtacattcccatctactaaaaaaatttattttacacatgtcaagggattacttataacttccattttattactaatagcttgaacccttttaatgaagacctaactcctccaccagaaatttaagtttatgttcttactttgtttacttataaaatacatctcaggtatttcggatgtcttttttttttctaagcctatatgaaatgaaaaatatattggcaaaataaatgtttaaaccttttacgttaaaattactttgaaagatgaaaagttagtgctgtttttgtctacgttatactgaaattaaatgtttataatttatattttgggtttatgtataaatcatggaatttatgcaaaaatatgagtagtacagattctcctctaattctgtaggactttgaataatgtgatatttttcttataattggacccttgtgttttgaagaaatgccaactgcttgaagaatctccttgttatttgtattatttgctatagggttagatgttgagaaattctgctgacaaaaaattttaagccagttttacactaaatgttcctcagtctgattaatttgttattggatgtattctgtatctttcttttgtaatttgtaacttttatccacttagcacgaatgattctattaaagaaaatcattaggaagtggtagaaactttaaatcgccccagagtttgcctgtttccatattttattaccttataatcttcgggagtgcttacacttatggagctaacattttcagagatacagcttcttatagtaacactaaaactttcttcctctttggactgaatacctataattataactatatggtagtttaagtttccttgtgattagtcaaaaataccattttagtatgaagcaatgaagtctattatttgttgtcccataattgagaaagcttaaatacaccttttattaagagtttgtaaattctagcttagtctacacagatttttatatcaatttgtttatatttttattaatgtcatttctggaagtgtgaaaatgttaatgttcaacaagcaacattaaaaatagatttgaaacatttatatatagagaggtacacatttatttactgtttaggtactgaagattatcacttaataaaaaatatatatccca

SEQ ID NO: 95 - DNA, 60 bp, Homo sapiens
ctgtgctgggcacagaatggacttcagttaagtttttgatgtagaaatgttttattattc

SEQ ID NO: 96 - DNA, 1893 bp, Homo sapiens
gccaacgatacgcctgctgcagcaggaggagttacgagccgggccgcgcgctgcctaaatacctaaaccaggtttagcgcctgctcatataaagctctcctaactcgtcttccggtgggaatttcttcacgtgggccggagtcggagactgagtttagctttactgaggagctctaaatttaggcgggtatgagtgatttcagtgaagaattaaaagggcctgtgacagatgatgaagaagtggaaacatctgtgctcagtggtgcaggaatgcattttccttggcttcaaacatacgtagaaactgtggccattggagggaaaaggaggaaggattttgctcagacaacaagtgcttgtttaagttttatccaagaagctctgctgaagcaccaatggcagcaagctgcagaatacatgtacagttattttcagaccttggaagattcagatagctacaaaaggcaggctgcacctgagattatttggaagctcggaagtgaaattctattttatcatcccaaaagcaacatggagagtttcaatacttttgctaaccggatgaaaaatattggcgtcatgaattatttaaagatctccttacaacatgcattataccttctgcatcatggaatgcttaaagatgctaagagaaatctgagtgaggcagagacatggagacatggtgaaaatacgtcttcccgggaaatattaatcaaccttattcaggcctataaagggcttttacagtattatacctggtctgaaaagaagatggaattgtcaaagcttgataaggatgattatgcttacaatgcagtagcccaggatgtgttcaaccacagctggaagacatctgcaaatatttctgcattgattaaaattcctggagtttgggacccttttgtgaagagttatgtagaaatgctggaattctatggggatcgagatggagcccaagaggtactcaccaattatgcatatgatgaaaagtttccatcaaatccaaatgcccatatctacttatacaactttctaaagagacagaaggcaccaagatcaaaattgataagtgtgcttaagattttgtatcagattgtaccatctcataaattgatgttggaattccatacattacttagaaaatcagaaaaagaagaacaccgtaaactggggttggaggtattatttggagtcttagattttgccggatgcactaagaatataactgcttggaaatacttggcaaaatatctgaaaaatatcttaatgggaaaccaccttgcgtgggttcaagaagagtggaactccaggaaaaactggtggccaggctttcatttcagctacttttgggcaaaaagtgattggaaggaagatacagctttggcctgtgagaaagcttttgtggctggtttactgttaggaaaaggttgtagatatttccggtatattttaaagcaagatcaccaaatcttagggaagaaaattaagcggatgaagagatctgtgaaaaaatacagtattgtaaatccaagactctgatactgaattttagttatttcacagttgtagctacacagtaagtagcttggtagatagttattgaatgtatttatgtagtgtattaagaagcttatattactacaaaaaacttatttttatatatttttatatttttgtattatttatagctagagaaacaatattactgcctttgctctttgtaactatgtctgttttcttttttgtaatgttaaatgttacatttgttaaggaataattcttcaaatgacaaactaattacagaatatagctctacagcagttattgtttgcaaatactttgcctcttgctattgtgtaataaactgtaacttgtaaaaaaaaaaaaaaa

SEQ ID NO: 97 - DNA, 60 bp, Homo sapiens
gctctacagcagttattgtttgcaaatactttgcctcttgctattgtgtaataaactgta

SEQ ID NO: 98 - DNA, 4196 bp, Homo sapiens
tctcattgacagccctgctccttggagattgtttttgtgggtagtcttgtgtgtggcattggtggaatggctgaatctaggagacgcggcgtgtccggaacttgctggaaattggttttgagattttgggcaaggcctctcaccccgagcctcagttccctccctaataaagcagggctgttataaggataagatgcaatcgtgagggggtgggaaaggactaagagctctgtaaaaatacaaaccaaatgctggtggtgcttccacacctgcggcatttggggtgggggtggtgacaacattgcccacactcaacccacacactcaggagttggggggggctggttcttaagacgagttggcttgcaaaggagtgaacttgagaaggacctgcgcctcgtgtatgtacatttgtttttggccaggcagaggcttacggtgaaaagcccaaggcccagctgacagtggacacaggggaatttgtttgtttgtttcaatccgcatctggagtgagtcattgccacttgtcatggtgaaatggcaaatctgggcttcctgtggttccagaagcctgcgactggaaatccacaagcgagctggtggttgaagctggttaaagaacagcctaggtattccagaagtgtttgaggatcccttccatgaaggaagagaggaaagtttttaagtaaacctcccactcccatgtgtcttcagctttcttttgcaaaggagaaaatccttgaagtttggtaaagaccgagttagtctatctctctttgcctatctcgagttgggctggggagaggaggagataggttcttttgtctttttctgtcttctcccttccccacttccctccctccagtccccactcactcacatgcacacactaaccttggagccgatgggattgagtgactggcacttgggaccacagagaaatgtcagagtgtttggttacagactcaaggaaacctctcattttagagtgctcatttggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagcccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaatcagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgtgggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaaaaaaaaaaaaaaaaa

SEQ ID NO: 99 - DNA, 60 bp, Homo sapiens
gtttggctgtgtctaaactgcattaccgcgttgtaaaatatagctgtacaaatataagaa

SEQ ID NO: 100 - DNA, 2595 bp, Homo sapiens
tcatattagtgcatttctttgcagaggttacctctttttcttgtctctcgtcaggtctctgacattgacagagcctggacgttggaggaagccccaggacgttggaggggtaaagtaaaagtccacagttaccgtgagagaaaaaagagggagaaagcagtgcagccaaactcggaagaaaagagaggaggaaaaggactcgactttcacattggaacaaccttctttccagtgctaaaggatctctgatctggggaacaacaccctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattccagtcaatgggcctcgtctagagagcctggtgctgacctacgtcaatgccatcagcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatcatgatgcatgcatttttgttgaaccataaagtttgcaaagtaaaggttaagtatgaggtcaatgttttacctacagagcaattcaactcatgcttatttatagtactaacttttaatatgatctttaactaaatcctatatttgaaatcatacacaaggactcaagagagatattgtgtaactaggatgcattttccaatgagatatcttgcagtttctgttctgggtagatttttttctctcatatgcaccacccttactgtatattcagtcctatactcttattcagggatttaactatggtcgtagcatagggctgaagtgttgtgaatatgatgaaaatgtgatgagaccaaacaaaccatggggcacagtagagcatcactcctgccaagtggtctttgtatggcatgctggctgcaaataaaggagatctgggac

SEQ ID NO: 101 - DNA, 60 bp, Homo sapiens
gagggattcgagaatgagagcaagagacttcaaaaagacatatgggatatccagatgaga

SEQ ID NO: 102 - DNA, 4229 bp, Homo sapiens
aacattgccgatgagacttggataaggaggggaccttgttctccatttcctcacttgatctttcacccgacaccacgtacgtaagtcctgtccgcctgcgtcagggcacactcctccaccttctcatccctgatgactgcacaggacacttggctgtgccaccagcgttctttgtgatgaccctctggtttacacagggacttccggacagtcctgcgatgtgccttggtgagcgcagacctttgtggatctggggggatagttttgtaggaccaaggccctagaagtagagatgctggttggcggtcagtgataactgtatcgatggcccttcagacctgtgtccccttttgctctcccaccagcaaaccatcaacgacccctcgaagtggctggcgcaggagccatcccttctcatgtcagcctgtcggagggtgcaagttgtacctccttgtttgtgtgtgcatttcctggctcgggtgagatggagccgggcgttaggttaggttggccctcgtgtcctgcagcctgtttgtgtccttcgcccgttgtgacatcgaggcattctgcttttaatttttgatgtgtatgagctcaaaataccacaaatactaaccatttgtcttttatatgtattgcaaagatttttctacttgttctttgtctctcagctgtgtttttctttcttgtgcaaacgtgtctttctctgattgtcacagcaatgtctgtgtgtgtttttttttaagcgtagaaaacctggaaaatacagaaaagcacaaagctaaagaaataaaattgccgggtgcttcgcctggagacgcacgctccctgtgccttgtttgattctgtcgtctcttgtgtgcgtctgctcttttattttttaaacaaaattgggtcacttgtcacctatgtggttccgtattctaatttttcacttaacattcatgatgtgcatatgtaacacactaaaatgataatgaggttgttttggggtggtggaattcgggggtacttttaatttttttttattttttttcctttttgttgatttgcatttttaaattgttctacagaggtcatatagtgctgatgtaattacatggtgggatggaaagccatttgctagagtggaccagggaaggagacccctggcaacgtccccacttgcaaacctcgtcccagtggtggctgcagtacagtggcgacgcgccttgggaaaggacccctccctgagcagagagagcacgctttggcctcttgcctacacagttcctggggtggggggcggcagggcgctcactcctgttggcggtggggaggctgagcttccaggcactggggtagtcacagagcggcagcctgggacccctttccctgcacctgtgcatgggagacagcgtgggagacgttgaggatcttggccctgttcaggccacctccaggcagacctcccgactggtggggctgttaccgctgcacccagcagccccctccttcttcaggctcctcctctgtccagaggaaatggctgtccctgccgacgttactcccagggggacaagatttgctgggcttgggaacggcaggagcagacatgccaaggctggggtgctcagtgttggcaccacgtggggaaagtcacgtgtgtaggcatcagctgtggcagggcagttgggcggcaggttttcaaaagacaaaaaatattcctgccccttcacctggtcattccactcgtaaggatttacccaaatcaaagtgtcctatatttggaagcagcctctgcggcctgcacgggatgggtgagtccgtggttgaacatggcagtgacaaaacctccgggtgccctgcactgccaggcaggtgcacgtgggcctggccagggtcccaggccgagttgatgcctctgggtgagctgggctccccgcaccccgtgagctccaccagcctcccccgcagacaagcaggccagcagggaaggcggtgtttccacaggggcaggcctaggatgaagccagggcccctctcctgaggtgcccgatgaatgtgtcctggaggattgtggcatgtgagcaagtacccttgagtgtgaacaagcaagcaagcaccactggatgtcatggctccagttttgtggaaagtggattcatctgtggatacggggacagaatctggaatgaggcagtttccaaagggatatgaaacttgggttggaagggcctggtccctggccctcccttgacctaggctgatcatgtttccatggtcacaaaagtgacagagagcacgttgtgcacgatgaggtagagagacgtgaatcttgtctgggtccttccagatctcggtgcagcctgaaaggcaccctcgcctcaccccacccctccctgcatgtggactccagggtggggatgggggatgggggatggcaggggggcgagctggggctcctaggaaatgcctggcggtgacgcgctgaggctttgcaggccatggtgagctgggcgcttctgccaggtgtctgggggctgtgggtgttgggctcctcctgggggtgggggacgggggttcccaaccaggccaggaggggatccttagagagggaccctcagcacatgtgcagcagtggatggtgggggtgggtctgtgcagggccctggaaactgcctgctgccctcccccaccccagcctgatggttctgtctctggctctttcagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctccctttttttaaacaaaaagcaaaaaagtaaaatgctgcactgcccagcagcccggttagggctcctggagccaccttaggaaagggcttctcatgagctctgctgcggcagcttcagctggcagagaggctttcccag

SEQ ID NO: 103 - DNA, 60 bp, Homo sapiens
ccgtgtgggccgtgctgtgtccttatgtcattgtaatataaatacagatttttatatctc

SEQ ID NO: 104 - DNA, 2858 bp, Homo sapiens
ggcgacgggtttggtaagtaggaaagtttcggttgaggagtaagagctgccgcgggagcagtaacccgcgcgggggaggccgacgtcggtcggagagggggtacgagagctgctggtggtgttgtcgtggccggagcggcccgcgcctgggctgccggcacttcgcggcagtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaaggcacacgactgtgctttcataagggaagcaataaggaatggcaagatgttgaagattttgctagagctgaaggctgtgataatgaggaagatcttcaaatgggcattcacaagggctatggttctgatggtctaaagttgttatcacatgaagaaagtgtatcatttggcgagtctgtactgaagttgacttttgatcctggtacagtagaagatggtttacttaccgtagagtgtaagctggaccaccctttctatgttaaaaataaaggttggtcatcattttatccaagcttgactgtggtacagcatggcattccatgttgtgaagttcatattggcgatgtatgtctacctcctggacaccccgatgccattaattttgatgattcaggtgtttttgatacatttaaaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcaggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctgaaaaaaaaaaaaaaaaaaaaaaaaaaaaaa

SEQ ID NO: 105 - DNA, 60 bp, Homo sapiens
gtaaaattgatttcagttcatcacacttcttcatgatgttgcccctaaattttgcacact

SEQ ID NO: 106 - DNA, 3354 bp, Homo sapiens
agacgttcggtgatgggagcgcaatatatgaggggatacagtgcctcaggtttaaaagagcaggaagctgagtgagaggttgcagaaaaagtgtcttcgctcggcagaggttacaggtggcatctcagaaagagctttgaggctacaggctgtagtcgggaaggggatcggagaactgtgtgaagggacagcttagggactagcgtcctgggactagggggaagttcgcgactttctgaagactggcaggaatgtgcctcctggccctcgatgcttcccccctgaggggaggcatcgtgagggactgtggcaggcttcactgaacgctgagccggggaggtccaactccacgtatggatccggggaatgagaattcagccacagaggctgccgcgatcatagacctagatcccgacttcgaaccccagagccgtccccgctcctgcacctggccccttccccgaccagagatcgctaaccagccgtccgagccgcccgaggtggagccagatctgggggaaaaggtacacacggaggggcgctcagagccgatcctgttgccctctcggctcccagagccggccgggggcccccagcccggaatcctgggggctgtaacaggtcctcggaagggaggctcccgccggaatgcctggggaaatcagtcatatgcagaactcatcagccaggccattgaaagcgccccggagaagcgactgacacttgcccagatctacgagtggatggtccgtactgtaccctacttcaaggacaagggtgacagcaacagctcagcaggatggaagaactcgatccgccacaacctgtccctgcacagcaagttcatcaaggttcacaacgaggccaccggcaaaagctcttggtggatgctgaaccctgagggaggcaagagcggcaaagccccccgccgccgggccgcctccatggatagcagcagcaagctgctccggggccgcagtaaagcccccaagaagaaaccatctgtgctgccagctccacccgaaggtgccactccaacgagccctgtcggccactttgccaagtggtcaggcagcccttgctctcgaaaccgtgaagaagccgatatgtggaccaccttccgtccacgaagcagttcaaatgccagcagtgtcagcacccggctgtcccccttgaggccagagtctgaggtgctggcggaggaaataccagcttcagtcagcagttatgcagggggtgtccctcccaccctcaatgaaggtctagagctgttagatgggctcaatctcacctcttcccattccctgctatctcggagtggtctctctggcttctctttgcagcatcctggggttaccggccccttacacacctacagcagctcccttttcagcccagcagaggggcccctgtcagcaggagaagggtgcttctccagctcccaggctctggaggccctgctcacctctgatacgccaccaccccctgctgacgtcctcatgacccaggtagatcccattctgtcccaggctccgactcttctgttgctgggggggcttccttcctccagtaagctggccacgggcgtcggcctgtgtcccaagcccctagaggctccaggccccagcagtctggttcccaccctttctatgatagcaccacctccagtcatggcaagtgcccccatccccaaggctctggggactcctgtgctcacaccccctactgaagctgcaagccaagacagaatgcctcaggatctagatcttgatatgtatatggagaacctggagtgtgacatggataacatcatcagtgacctcatggatgagggcgagggactggacttcaactttgagccagatccctgagtcatgcctggaagctttgtcccctgcttcagatgtggagccaggcgtgttcatatctactctttacccttgagccctccccaggaatttgggaccctgctttagagctagggtggggtctggtcacacacaggtgttgaagaaattataaagataaagctgccccatctggggacgatatggggagggagatgggaggggaaaggggagagggtttttctcactgtgccaattagggggtaaggccccctctcaggagccatcatcggctttccccattcctacccacttaggctttgtagcaagatgagcaatgctgttggaaatgtgaagtcaccagtggccttacccctgcctttgggagcaggatttttttgtagagagtcttatctgagctgagccaggctagctggagcctgggatttctatgcagtggccccttaggccagtgatgtgcggtgggtgggctgtttaggggatctggaagggccaaggtctgagcactggagtggctcgccaggccaaatcacccttagaaggctgcagataacagaaaggctttttataaacttttaaagaaatataaacacaaatatagagattttttaaccatggcagggtgctagtggtgggcagaatgcttttttttctttctgaaggctttgtgatagtgacatgatacaaacactacagacaataaatattaggagacacagggaagtggggagaggtggggagtaatagtaaacacagggaagagctcccctacggaccaggtatagagaaaggtctatgcagaaataggttagagtttccctaacaaaaaagctaacccaggtcccctcattccttcaacttgtgcctgggagtgtgtggtgttagggtgcagccacactcttctatgacccagcatgggttagtgctatggtgggagagtacattgaaggcctggaattagcttggggccagggaagggactgggaggggagagaagagaaggagggaaggatttaggatggtaaagttaggtacagagacctccctgttcaaggcccctgacagctgtccctgcccttcttccccttccctgactgcaggggttatgtggaagtgtgtgtggcagcaggcagcggggaggggaggaacagggaagggggagctggggagcttggctgagggtctgggaaatgagcagggatggggggggatgtggatcaggtttactagcacctgccagggaggccatctggggctccttctccaccccagcccccaaagcagcccttcccccagtgccctttgcatcgtcccctcccccacccctgctgtgggttcccatcatttcctgtgtcagcgcctggcctacccagattgtatcatgtgctagattggagtggggaagtgtgtcaaatcaataaatgaataaattcaataaatgcctataaccagcagaaaaaaaaaaaaaaaaaaaaaaaaaaaaaaa

SEQ ID NO: 107 - DNA, 60 bp, Homo sapiens
ggagtggggaagtgtgtcaaatcaataaatgaataaattcaataaatgcctataaccagc

SEQ ID NO: 108 - DNA, 1948 bp, Homo sapiens
ggcttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaattgcgtctgatgcaagttatcctgtgaatcacaaagtgtactgtctcaaaaaatagaagaaaatgtgtcttcgtcttta

SEQ ID NO: 109 - DNA, 60 bp, Homo sapiens
aggtgaactcagatgttatggttttgtatatgtctgcaatcatggataggaataaaatcg

SEQ ID NO: 110 - DNA, 2212 bp, Homo sapiens
cagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaattttttttttttttttttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacattcaaaaaaaaaaaa

SEQ ID NO: 111 - DNA, 60 bp, Homo sapiens
tacagaaaaacacaaaaaggtgatgggttgtgttatgcttgtattgaatgctgtcttgac

SEQ ID NO: 112 - DNA, 3949 bp, Homo sapiens
ctgttgctcagacggacctgcaggcattctccatgcagaacggtctgaatggacaagtggatgtctcacttgcttctgcagcctctgctgtggagagcctgaagccagcactccttgctggccagcctctagtgtatgtgccctctgcctcactgttcatgctgtatggaagtctgcaggagggaccagcgtcagggtcagggtcagagagggatgacagaagctcagaagccccagccacagtggagctgtcatctgcaccctcagctcagaagcgcctctgtgaggagaggaaacctcaggaggaggatgagccagccactaaaaggcaaagtagggaatatgaagacggcccgctgtcgcttgtcatgcccaagaaaccctcagattccacagaccttgcctctcccaagactatgggtaacagggcatctatacccctcaaagacattcatgtgaatggccaactccctgctgcagaagagatttcaggaaaggcaacagcaaactctcttgtttcttctgagtggggaaatccttcaagaaatacagatgttgaaaagccttcaaaagaaaatgaaagcaccaaagagccttctttgctacaatatctttgtgtgcagtctcctgcaggattaaatggtttcaatgtacttttatctggcagtcaaaccccccctactgtgggcccgtcctcaggtcagctgccgtctttcagtgtcccttgcatggtcttaccatctccacctctgggcccttttcctgttctctattctcctgcaatgccgggcccggtttcttctactcttggatcaatagcccagcttctcgtcggccccacagctgtggttaatccaaagtcgtccacactcccttctgcagaccctcagcttcagagtcagccctcactaaacctaagtccagtgatgtcaaggtcacacagtgtcgtccaacaacctgagtcccccgtttacgtgggacatccagtctcagtagtaaaattacatcagtcaccagttccagtgacccccaagagcatccaacgcacacatcgtgagacgtttttcaagacacccggcagccttggagaccctgtcctgaagagaagagaaaggaaccagtcacgaaacaccagctcggcccagaggagactagaaatccccagcggcggcgctgactaacctgccgctttgccaggtgggggtgggatcaaacgccctgagagtcccggatgtccgaggcgggatgcaaaccatcccgtcctgagcacgggtccttcctctctctttcatccacacttctgttaacttcccaccaccatcaatcatctgatttcctgaaagtaattaattgtgcatttaataccagttagagttccgactctgcatggtgtcacagtgaaagcgccgactgacttatggttttgattcaagaatcgtcttattgctggaagtagatctgaataggataccggagccttgtttttctaaaggggggcgctgtctagcacttaactagggtaagcattcttaacatgtatttccacttgccctgagtaaatctgtggtgagagaagcttcctttctgcagtttaaaaaagctactgcttccttaggcttcatcaggaagccatcttcagttgtgaatcctatggtgttatttattttgttcctgaaatgggatttagtgcaaaaagtttacaactacagtctttaacacatttttttcagggtatgacgacttgaatgtttatacttttattctataatttgccctgcacttattttacaacctagtaataatgtggataaatgtatctacatgacacatgtcaagaccaaaataactgtgaatgacacaccttgctgtaaatgaactgtgctaaccctgactgtgggcttgagaacaaagatgaactctagaactctagcagcctaactgctgcttctcaaataactgtgtgaacagtgagatattactgtttgtttctaaaaatcctactgtgcccagtttccttcactacatgccctgcattttttatttaaatatttagctgtagcgccatcagatatggatgccttctaacaattgctgtttgtaaaataaatcaggatggtagaaagtgattatatggaaaattggaacctggatgagaccttttcgttgaattctgaagagtaatgatgtgaaaattgatacagggcaagagatgattcttttgtttttcttctacttcatgtccagaagagtaagagggaaaatggacatatgtttcatatccaagggtattcaaactgtagttagttggtacctctgaaaaatgagaatggtgagcgcacgggttggttgttctagcatgaatacaattctggaaactgttatgcaatttcccttttttaacccacattactttaggggtgcattaagtcgccaaactatactagttctttgtattcctagacttgctgatatttacctctctcttgtctcttcagagtaaatggttcccttctttccttcctactttccttcattctctcttccttccctccttcctacttcttttcttccttcctcttcctctcttaaaactatcttagatgtagaatcctggtgtagggttttattttatttttattttttgacccaataaaatgttatatgaaagaatgaaaatattaatttaagagactctgggagtctgaataaagtagctttatattaactacaggataatattagccttattacccccacaagattttttaaaacttgaggtaggtagctacattaaataaatttgctacttatataaaaatttttatcaacactaaacttttaaagtttacaagttttttttttcttttttacagtcttctatagagttaggttaaaatgtggttctaaccatcaacaattgcatggttaaatgaccctgaactaaaactgatgggttccctatcaaaacaaataaaaatatacctttttcaggtttcaatctgtgcagggtatatgcatgttaattctaccatgcttaagaacttccacaaaatatttcatggagaggtctgcatttagacggaaacagaaattgcttttcccctcactgttcctgaatgctctatacttgttttaacatttttgctatctttttttattattctgatcatgatatgaccatttaacctcagaattcataattcctgaggggtgttaagaagcagtcccattggtgaggatattatgacttggtgaccattcttaggagtagaaaaccaaggacaattgcttctgtattcagtatccacttcttaatgtggctttatatgtaaaaataataatgcagtggttgtttctgtcaggaaaataaatcttacagaacaactggtggaattgaagctgctgcgctagacttggatattttgggtagtgaagaagcaatggcaatcttgagtctattattgtataatttagtaaaagaaaaaaataatcgttggtggtcctactaagagaatgcagcttttttgagttgtcacagaggctgtgtgtgccctacactgaccagggtttgtaaaaccctttcattctggtacaagagtcgggggtataacttttatacttgaatctacctaccaagtttacatttctcaattcctttttgtaaggtgctatttctgtatttaaataactttcttttaacgtaaagctgctttctgcttatcttattgcactgctagttgtatgtaggtattaattttattgctgcttactgcttttgttttcttattatttagctctgctctttttcctaatggctatattatctatagctatttacttgtaactgtactacatgtaaactgattttttgttctgattttttttctaatatttttaggaaaatattaagctttataaaatagcaataaaaaataattcatttaagaag

SEQ ID NO: 113 - DNA, 60 bp, Homo sapiens
attctggtacaagagtcgggggtataacttttatacttgaatctacctaccaagtttaca

SEQ ID NO: 114 - DNA, 4723 bp, Homo sapiens
gcaggtacccgggaattcggccacggccgacatgtttttttttttttttttttcctttttgtctgtctttatttacagcaaagtacataatatgtggtcactttgtaaccactaacaataaaggtagggtggtaaaaagaaaagggagaggagcaagcatcttaaaaggggggaaaaaaaaaagcctaagtctgtatttagctactcaccctgctcctgaggcaggactgggtaggcactccctgcctctaagaccacagccaagctgacctggaatgccagtccccggtatgaggaaggcagcagaacgcccagagacaaaagattaaaggggactgagctctggatgcatccacttatgctttgccagacagttcccttccttgttttgtttgaatgcttcccccaccccgccctgagcaaagtgtaaagggcacggtggtacagaagtacaggcagtcccttccagaagcagtcctgaaccgcataacccacctacctagctgctcctcagcctgccgagttcttggccctggaatctttaacaggtacataggagattccagggcaggggaaaatatttccctgcaagaggctacttccctccaacagctgtgagggccagtgcaggtcaaggttgctaaatcaaggaaagtgcacaagggcaagagaggtcatatacaaaccaaccaggcttccggccctcctgctgcccgactgctccgaggtgtacacaagcctccagcccgacccagcggcctaatgaaactctggcaacctatcctgggcgtggccacgagtatccagctccaagcccaagtgaggcggggagtcaacttccccatgattgccaagtggccaagaccagaagcagggacgattaggctagttctgcggcaaggtgaactggagaccctgtctctgccctccttccctggcctgtcccacagacatcccgttgtttaacccactgcctttgcaaggacctgctctgtccactccaaatcaaaggatacttgcatccttcttacacagactcccatctctctgctcatagtggtcccaggctgcccgagaaaaagaaacttgggtcagtagaaggctcattagtgtgaaggagtgagaggccaggccttcctgtgacataatgcttctatgcttgtttcctaaacacttggtccacacacaatacctgggcaggaagagagaaccaagcaccactggatggctctggagccaggggacttctatgcacatacaaccaacatcaccccactctgctcatctgtgcctccaccctgaacagcagagtacctagatggcaaatgtcatggtttctggtccactaattctactcctgactctccatggaatcagagacccagaggctcttaaaaaactaagaccattgtttgttccatagaaagctcaagttcagatacagagttggccaaatgctgggctgccacggaggggtagagccttccatcccttccttgttccagaaacagtgtgtcacagaccccagcagacactgttcattgtccccagccaagccaccaagaattggtgatcatttgacaaggggcagggcagcccttatagctgtttccaagctaggagtgggctattcagagatattggaggcttggtcccaacaccacaggtagatgaggaagcagctaggtaaaggctcagagatgagaggagtccatcttccaaggcagtgggataaacagccaaggcactaaatggtttggcacctgggagcttcaagtaaagttgagcatgctgcccactgaaaagccaaggctctcccagacacgggtgggcttcacctgagcacggcccagtgccatcaaggccaggggccctgtgtcctcaggatgctaacccaggcctgcattccctgcttcatctcagaactgatcaaggcatgactacaaggataatgattgatcctgaactgatcttggtgagcaccggctttcaaaggaggcatcttgggagccttcccttgctccaagtaggcggctgctgtgactgggagctcccttcagagcctgcacggtctcctgaaagtctccgggtggcaagctctgctggggaccaggtttgactttttaaaatagcaaaacagatttagagtcaaactgagcccagaaacggggaatcagactggatggtgctgagtctgggggaaaatctggtgtgaccaggtaataatggagaccaatttacctgaatggctcgaacaggctctgagagcaatgggaagaaaaggttctccaaaatgtttctggcaatggcagccacagtgggatagctaagggcacagtccaccaagcactagggtggtcaacaatgaaatgaacatctctggcccttctgcagtcagaaactgaggctcgggactctataatcagaactccttcaggctcacttgggctcccctccacccagaatgtcaggaatctgtacttccagagaaaacactaccaccaagcagcagctctcaggaaagctagaaatctccaccccaaatatttcaacctcaggctccaacttaggtacctatgatttaaatactctccttttaaatactttgtaaaaactgcttttccgagccccttttatgctctgcagttgccatatccactaggtggtattgcaaataagtaaagcatcctggccatgacgctgctagtgagaatccctgaccaaagttactctcctcacctcactgcaaacctccaggaagcggaaactactacccctccacagacagagctcccctgccactccatgaggcgctgctgccggcatcagttaccgaagccctcacccacacccagcctgcaatggtccactctatattccacaatacaggaaaaagcccaaggagtcagatcagttacgcccctgggatgcagaaagaaccagtgattcttcagatatgacagcaggcaaagttctgccctctccttcccatcttctatcaggaagcgatcccataaaatctcttccagggaaggaaagaggcagctctggcttcttggagagacagagaagcaggagggtgaggaaggagtcaccaagctatccaagcagccagaggcaagaaggtgggagcagggcaggaagaaaatgcagaagacttgttctcctcagtgggcctcttccctgagtttgatttttgagttgagattttacctaatttcaactcaaaaaaaaaaagaaaagaaaaaaaaaaaagacaagagtatctctcattgacatatcactaagctccagctccaagagtggcatgtgacagaggaggcaatcaaggtgttccaaccccattcccatcaagttccacggggcactcaaaagcaactggaccttagccaccctccctgtctctcacagatgcccgagcctccccaccctgggacacaacaggcaatttccccttggtgaaattccagctccagtcctaaaacactcaagtacagaccctcctgcaaaatacttatggcaaacagctttacagtatttgtacatttacacaaaaatagatccttttttatatatatatgtatttataactggttacacgttggattcataattaggcatcaccagtagtagttggcacagttttgttatttaagctcagggtcaagttctgtttcattttgtcgttccaaagtacaaaaagaaaaaaaaaatcaaaggcatttcatctccatggtgttttcttaaatacagtaatgtcataggaaacagtatgtacagatgagcagtgcctcctgacccctcctctgtctcttggagataggggctggggtccgatggagacgggtcaatgcggcctgctgctggactccgatgcctgcctcttgcgtgaaggggtgtagccgttgagacagccattggtctgccgtttggagggccctccattcaggatgtcctggatgtgctgcacgatgaggttgatggccaccagattatctgcacctctagggatgatcacatcagcatacttctttgttggcaagcagaattcctcaaaggcaggcttgacgaacgtaatgtactgagataaaatctgctcaagatccctgcctctctcgctgatgtcccttaatactgtaagagaagggaaaacaagaatcaaaaaacggtgtaggagccagcacacacccgcccttcatggggtggacctagctcccacaggctccacaattactctagatgattctcaagctggaatcctgagaggcttgaccaagagcagatcagcagcggcttcggaaaagacaagttacattctgacatcttacaatggtcaaacttggcaatgacacaatgctctttgaaacaaaaggctgtccatggaggccaacagccttcttgtttcaagcaacatttgctccaaacaaaatttcagtgtgaattttttaaaaaagcagggcactcctggagagctcactgttaacaagaagcaatctgggccccgagagggctgggctgcacgctgcctccttgcatgcacttacctgcgttcagaagtccagcgacccactgatcaggcatcagctcactgctcccagctcccacccatgccccctctgcagcatggagcccaggccaggctgaggacccagccatggttaaccatttccacctacctcatgcacagaggtttgccaaaaaaaaaaaaaaaaaaaaaaaaaca

SEQ ID NO: 115 - DNA, 60 bp, Homo sapiens
ccaactactactggtgatgcctaattatgaatccaacgtgtaaccagttataaatacata

SEQ ID NO: 116 - DNA, 2860 bp, Homo sapiens
gtgcgcacagcctagagcccgcctccgtgaaagactgccgggcgcatgcggtcggggttgttcactggctgtccggggctccgcgcgcgtcgccggcccagctctgtcgctgacgggaggatctgaagccggccgcaggtcaaagagtaaaatgaagtacattctggttactggtggtgttatatcaggaattggaaaaggaatcattgccagcagtgtgggcacaatactcaagtcatgtggtttacatgtaacttcaatcaaaattgacccctacattaacattgatgcaggaacattctctccttatgagcatggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaagttgtccctcatatcacagatgcaatccaggagtgggtgatgagacaggcgttaatacctgtagatgaagatggcctggaacctcaagtgtgtgttattgagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtgggcaaatacacgaagttctcagactcctatgcctctgtcattaaggctctggagcattctgcactggccatcaaccacaaattggaaatcaagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttttttgggcgtgtgcttagggatgcagttggcagtggttgaattctcaagaaacgtgctgggatggcaagatgccaattctacagagtttgaccctacgaccagtcatcccgtggtcgtagacatgccagaacacaacccagggcagatgggcggaaccatgaggctgggcaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggattggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaagaaaaaaaaaaaaaaaaaaa

SEQ ID NO: 117 - DNA, 60 bp, Homo sapiens
cactatattctggccagactcgatgtgtactctaacttaagaaataaatcagtaaggcag

SEQ ID NO: 118 - DNA, 3727 bp, Homo sapiens
cggccgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaagtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaaggtctggaccataacttctgtcagggcagagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctacctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacattagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtg

SEQ ID NO: 119 - DNA, 60 bp, Homo sapiens
gttttgtacagacttgtttttgagtgttgagtagcagggacaaaataagggaatgttatt

SEQ ID NO: 120 - DNA, 2900 bp, Homo sapiens
agtgtcgtgtaaacagtgtccttccgcgcggcggccgcggagagagctgcggcccgggggggcgtgcctgggatccggagcttcgctcgggcccgggaaaggcggcagtgggctgggatcgcggtgtctctgggtgtgatggccaatggctggactggctcccgccctgggcggaggaatcccgagctgtgaagcggctggaatccgggcccatgtgcttctttgtttactaagagcggaagcgatggcgggagcgggggtggggtgcggtggcggggtgcggtggcggaggtcccggtgaaatcaggggctaaggggacccaaagaaggcgggggatcataggggtggaaagaaagctgagaaccttgagaccggagtgtgaggggccaacggggaagggcgctagaattttaaactaaagtagggaccggaattcccctggggagatgttggatggccctgtgcactgccacgggctctttattcttcgctggttagaaacagacttgtgaaaaagagttatgcccactttggggagacttcgaaaaggttaagaagttcttacaagagttctaccaggatgatgaactcgggaagaagcagttcaagtatgggaaccagttggttcggctggctcatcgggaacaggtggctctgtatgtggacctggacgacgtagccgaggatgaccccgagttggtggactcaatttgtgagaatgccaggcgctacgcgaagctctttgctgatgccgtacaagagctgctgcctcagtacaaggagagggaagtggtaaataaagatgtcctggacgtttacattgagcatcggctaatgatggagcagcggagtcgggaccctgggatggtccgaagcccccagaaccagtaccctgctgaactcatgcgcagattgtgagtggtctctgtcgggaaagatgtagggattggttctccaggatcttgtttgtgactgttttctccccttagtgagctgtattttcaaggccctagcagcaacaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccgatccagtctcccactttcatgcctctgatcatgtgcccaagccaggagtgccaaaccaaccgctcaggagggcggctgtatctgcagacacggggctccagattcatcaaattccaggagatgaagatgcaagaacatagtgatcaggtgcctgtgggaaatatccctcgtagtatcacggtgctggtagaaggagagaacacaaggattgcccagcctggagaccacgtcagcgtcactggtattttcttgccaatcctgcgcactgggttccgacaggtggtacagggtttactctcagaaacctacctggaagcccatcggattgtgaagatgaacaagagtgaggatgatgagtctggggctggagagctcaccagggaggagctgaggcaaattgcagaggaggatttctacgaaaagctggcagcttcaatcgccccagaaatatacgggcatgaagatgtgaagaaggcactgctgctcctgctagtcgggggtgtggaccagtctcctcgaggcatgaaaatccggggcaacatcaacatctgtctgatgggggatcctggtgtggccaagtctcagctcctgtcatacattgatcgactggcgcctcgcagccagtacacaacaggccggggctcctcaggagtggggcttacggcagctgtgctgagagactccgtgagtggagaactgaccttagagggtggggccctggtgctggctgaccagggtgtgtgctgcattgatgagttcgacaagatggctgaggccgaccgcacagccatccacgaggtcatggagcagcagaccatctccattgccaaggccggcattctcaccacactcaatgcccgctgctccatcctggctgccgccaaccctgcctacgggcgctacaaccctcgccgcagcctggagcagaacatacagctacctgctgcactgctctcccggtttgacctcctctggctgattcaggaccggcccgaccgagacaatgacctacggttggcccagcacatcacctatgtgcaccagcacagccggcagcccccctcccagtttgaacctctggacatgaagctcatgaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctatcctgcgcctttccactgctctggcacgtctgagaatggtggatgtggtggagaaagaagatgtgaatgaagccatcaggctaatggagatgtcaaaggactctcttctaggagacaaggggcagacagctaggactcagagaccagcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttgaggggaaggaggagcccctctttctcccatgctgcacttactccttttgctaataaaagtgtttgtagattgtc

SEQ ID NO: 121 - DNA, 60 bp, Homo sapiens
ggggaaggaggagcccctctttctcccatgctgcacttactccttttgctaataaaagtg

SEQ ID NO: 122 - DNA, 2447 bp, Homo sapiens
ctccttcctcagcggcgggaagctggcggcagcggcggtggcggtggctgagcagaggacccggcgggcggcctcgcgggtcaggacacaatgtttgcacgaggactgaagaggaaatgtgttggccacgaggaagacgtggagggagccctggccggcttgaagacagtgtcctcatacagcctgcagcggcagtcgctcctggacatgtctctggtgaagttgcagctttgccacatgcttgtggagcccaacctgtgccgctcagtcctcattgccaacacggtccggcagatccaagaggagatgacgcaggatgggacgtggcgcacagtggcaccccaggctgcagagcgggcgccgctcgaccgcttggtctccacggagatcctgtgccgtgcagcgtgggggcaagagggggcacatcctgctcctggcttgggggacggccacacacagggtccagtttctgacctttgcccagtcacctcagcacaggcaccaaggcacctgcagagcagcgcctgggagatggatggccctcgagaaaacagaggaagctttcacaagtcacttgatcagatatttgaaacgctggagactaaaaaccccagctgcatggaagagctgttctcagacgtggacagcccctactacgacctggacacagtactgacaggcatgatggggggtgccaggccgggcccctgcgaagggctcgagggcttggctccggccaccccaggccctagctccagctgcaagtccgacctgggcgagctggaccacgtgatggagatcctggtggagacctgagcaggagccctgagtgctcacagccgcctctgacgcattgacacgtgagcactggctcccacggagggtgcgcctgccgccagcggcccagccttgctgccctgtctgctgattctgagaaatcccagaacagcccattaccagtggggctgcagccctaggcccgtcccactcacctcccccctgtggagggccaggcagaggctgttctggaaggcttcttgtcttctgacgtccccacagccctgggcccctcgtgtctctttgtgtcccccactgtagaggacggtgagccgcagctgcatcaacctccttttacctttagataggtgaatttttacaattcagttttacatgtttcgggcagtattttgtcttaagatatattttttaaactttttataccttatctctttagattttttcagctattttcttaaaagtatattttttctataaacatcctttgctgctacattagaacttttatagcctaaacaattgcagttggtgtgtttcatttttttaaggtttaaataagggttttttgttttgttttgttttttgcagtgagcatcactacagtctcagtcaacagtgtgaatgtatcatgttttactttaaatgtgtgtgtgatacttcttcattatgtcctgcgctgcagtgagacctgggtgaaaatcaggaaccgcacacagccacatcttcctagacctaagagtaaattatggaggattttatttatgtctatttatatgtaaatgtcattgaagacaaaggtcaaatatttgtctgtttgtagatcacaggcaccagttggtcttcagggacctcatagcccctcggtggtgccttctcaaggcagtgttcctggaggctcccgtcagggtcagcccatgcacctgccctgggtgaggaagtagcattgctgctggatgagaaacgcctgcgctgctctgttagactggtgctgaaacaaaaggttaaggctaggttgaagtctagaatgaaagaaatctgaatccatgtcattcataaccccttgatctgtagtgtcatgggtgctgccgcaggcagggagtgagctgggggtgcctgcagccttccactcctgccccgcctcaccccacatgctccctgtttctcatgctttctctaacttcctcaccccttaaccaaaaaggtgtgttttcttttgtgcatatagccattcttaaatatcagtgatgtaaacctcactttattaaaaaattatccagcaaacaaaatgggaatgtggtgttagttacgacccacggcctgaccctccagcaacctttctgcaggatcagttctgctgtattatctggtggtgctttctaaggtggggaaaggaattgcacttggctgcattaaatggacgctgggttacttttatttccccccccacagggttgcagagcaaattctttttacattgttcagcgcccggctggggttgggggtgtccacgacctctgacagcccccgatgtcgaaagttaatcctcatggaccctagtttaaagggtatgtattttataggaataaatctaaagcactattttgtttctgtatagcatttttatcttttagaaacatcatttgttcagc

SEQ ID NO: 123 - DNA, 60 bp, Homo sapiens
ccccttaaccaaaaaggtgtgttttcttttgtgcatatagccattcttaaatatcagtga

SEQ ID NO: 124 - DNA, 4619 bp, Homo sapiens
gaaggcgtcccggcatcggccaagattctacattgctcatctgggcatctgagcctccttcgaagtttcctgtcacaactgtcctcttgacagcatggatgaggaggaagacaatctgtctctgctgaccgcactgctggaagaaaatgagtcagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaagaggaattaaggaatttgcaagagcaaatgaaggccttacaagagcagctaaaagtaacaacaattaaacagacagcaagcccagcccgtctgcaaaaatcccctgagaagtctccccggccacctcttaaggagaggagagttcagagaattcaggagtcaacatgcttttctgcggagcttgatgtccctgcgctaccaagaaccaagagggtggctcgaacaccaaagccttcacctccagatcccaaaagctcatcttcaaggatgacaagtgcaccctcccaacccctacagacgatttctcggaacaaacctagtgggataactagaggtcaaattgtggggaccccaggaagttctggggaaacgactcaacccatctgtgtggaagccttctctggtctgcggctcaggcggcctcgagtatcctccacagaaatgaacaagaaaatgaccggccgaaaactgatcagactgtctcagatcaaggaaaagatggccagagagaagctggaagaaatagattgggtgacatttggggttatattgaagaaggttacgccacagagtgtgaatagtggaaaaaccttcagcatatggaaactgaatgatcttcgtgacctgacacaatgtgtgtccttgttcttatttggagaagttcacaaagcgctctggaagacggagcaggggactgtcgtagggatcctcaatgccaaccccatgaagcccaaggatggttcagaggaggtgtgtttatctatcgatcatcctcagaaggtcttaattatgggtgaagctcttgacctgggaacctgtaaagccaagaagaagaatggagagccgtgcacgcagactgtgaatttgcgtgactgtgagtactgtcagtaccatgtccaggctcagtacaagaagctcagtgcaaagcgtgcggatctgcagtccaccttctctggaggacgaattccaaagaagtttgcccgcagaggcaccagcctcaaagaacggctgtgccaagatggcttttactacggaggggtttcttctgcctcgtatgcagcttcaattgcagcagctgtggctcctaagaagaagattcaaaccactctgagtaatctggttgttaagggcacaaacttgatcatccaggaaacacggcaaaaactcggaataccccagaagagcctgtcttgctctgaggagttcaaggaactgatggacctgccgacgtgtggagccaggaacttaaaacaacatttagccaaagcctcagcttcagggattatggggagcccaaaaccagccatcaagtccatctcggcctcagcactcttgaagcaacagaagcagcggatgttggagatgaggagaaggaaatcagaagaaatacagaagcgatttctgcagagctcaagtgaagttgagagcccagctgtgccatcttcatcaagacagccccctgctcagcctccacggacaggatccgagttccccaggctggagggagccccggccacaatgacgcccaagctggggcgaggtgtcttggaaggagatgatgttctcttttatgatgagtcaccaccaccaagaccaaaactgagtgctttagcagaagccaaaaagttagctgctatcaccaaattaagggcaaaaggccaggttcttacaaaaacaaacccaaacagcattaagaagaaacaaaaggaccctcaggacatcctggaggtgaaggaacgtgtagaaaaaaacaccatgttttcttctcaagctgaggatgaattggagcctgccaggaaaaaaaggagagaacaacttgcctatctggaatctgaggaatttcagaaaatcctaaaagcaaaatcaaaacacacaggcatcctgaaagaggccgaggctgagatgcaggagcgctactttgagccactggtgaaaaaagaacaaatggaagaaaagatgagaaacatcagagaagtgaagtgccgtgtcgtgacatgcaagacgtgcgcctatacccacttcaagctgctggagacctgcgtcagtgagcagcatgaataccactggcatgatggtgtgaagaggtttttcaaatgtccctgtggaaacagaagcatctccttggacagactcccgaacaagcactgcagtaactgtggcctctacaaatgggaacgggacggaatgctaaaggtatgccatttgcgtactaatttttgactccttttagtgacccatgctaataatgtggaaccatctcctattaaaatattttcatttttctaggaaaagactggtccaaagataggaggagaaactctgttaccaagaggagaagaacatgctaaatttctgaacagccttaaataacccgaacttcagacattttcccacagacttcctggcctcctgtgactctggaaagcaaaggattggctgtgtattgtccattgattcctgattgacgccgtcaaaaacaaatgcttgttaagcccataagctttgcctgcttactttctgccattgggttggtttgataccacatttaacattgacatttaagtggaaaaccaagttatcattgtcttttctaagctcagtgtggatgattgcattacttcattcactgaagtttttgcccaaaaattggaaggtaaacagagagctatgtttctgtatcttttggttatagagtgttcacttctttatcataacaaaattctagtgtttatacgaacacccagaggcaaaagaatttggcttaattctcactccaggtaagtagcttaacttctgggcttcagttttctcatctgtaaaatcaggaagattggactaagtgatcctgaaatgtattttttagcactggatttctacaaataataaaactttcccatctagataatgatgatcacatagtcttgatgtacggacattaaaagccagatttcttcattcaattctgttatctctgttttactctttgaaattgatcaagccactgaatcactttgcatttcagtttatatatagagagagaaagaaggctgtctgctcttacattattgtggagccctgtgatagaaatatgtaaaatctcatattattttttttttaatttttttattttttatgacagggtctcactatgtcaccctggctggagtgcagtagtgcgatcgcggcacactgcagccttggcttccctgggctcaagcagtcctcccacctcagtctcccaaatagctaggactacaggcgtgcgtgaccaagcccagctaatttttgcattttttgtagagatggggttttgccatgttgctcaggctggtctcaaactcctgagcactagcaatccacccacctctgtttccaaaaaaaaaaaaaaaatgaaaggtcaacccctatgcaaattaccacagcaaaggtttcattcaggagattcttccatctgggcaacctggttttccaaatatcatttgacctaagtgaatgttgatactagctaaagattgggtaaattggttgaattattgtattgaagcttgagctgtagctaaaagtaatttaggtttcccctaagatgttattatgttagggacataacacttttgggaggttgttgtgggagatggttgatttaggttttcaaaagctagaaataaaatttacatgccttagatttcataaaattctgctctaattgggtggaaggtgctgtatctaacttgtgttcctcctaaggttatgtcctaataactattcttttaggagtatacttctactttatagaaggttgcttttctttttaattttttctaacaaagaaaagaataaagtatttattaataagaaccagaaagcacttgaaactgatgtttttaatggctcatttagggtagatttatttatctcattaacttaaaacagctatgtgtatgaaataggtcacaacagaacttgaacaccaggttggtgtctgagcaatccctttcttatgggaaaaacaatgttcttgtttgaacagagggtatcattgcagtcagtattcacgtgtatattgttatataagttgtataatatgcttgtaaaggctgagggtgagctgtatctggatgcctttttacaatttgattttaacttttaaaataaatttaaaacataaaaaaaaaaaaaa

SEQ ID NO: 125 - DNA, 60 bp, Homo sapiens
tgtataatatgcttgtaaaggctgagggtgagctgtatctggatgcctttttacaatttg

SEQ ID NO: 126 - DNA, 5359 bp, Homo sapiens
agaggctttcagctttcagttatttgagaagtttgttttagatccttaactaatatttatgaattctctcaccctgtgtaagtagcctggtgttcgtttgtccaagtgtacttacccttgagaacaagtcttgcagttgccaggtgtgtgcagacgcctctcctgtgagcggcatcgcgggcccagtcagctgccccggctctcatcctcgtcctcactgccttggctgagcactgttgacgtgaacagccactgcaacaggcagcccatcccactgtcccctctgccctggactccgcatggcctccaaaagccagcttgccctccgggtgctgcaggggctttgcaggtggggaaggctctggtgggtgcctttggtggcttccgtgacatcagccgtgctctgatgcaggcttgctccctcgtcattctccctcgtcattctccctcatcgttctgtgtgcatttttctctatgtcctgacctttcttcttgcacctaaaagtggtgtctgggtgcaaatgtaagcagtggtggatccagaaatatgagctttgtgtaataagcttcttaaaacagtcctttcttacacctgcccagggccagaccctcggtcttggcctttttcaggagctaggatatctgcgcctggtgaaaatgaaacgaattcctgatttaggaattcagtgtttcctcctcactccagctaagcactcactttttttttttttttttttttttttttgatacagagtctcgctctgtcacccaggctggagtgcagtggtgcgatctcggctcactgcaagctccacctcccgggttcaagcgattcttctgcctcagcctcctgagtaattgggattacaggcatgcgccaccatgcccagctaattttttttttttttttttgagacagagtcttgctctgtctcccaggctggagtgcaatggcgtgatctcggctcactgccagctccgcttcctgggttcacgccattctcctgcctcagcctcccgagtagccaggactacaagcacccgccaccacacctggctaatttttttgtatttttattagagacagtgttttaccgtgttagccaggatggtctcgatctcctgacttcgtgatctactcacctcggcctcccaaagtgctgggattacgggcaagtttttattagagatggggtttcatcatgttggtcaggctggtcttcaactcctgacctcaggtgatccacccgcctcagcctcccaaagtgctgggattacaggcatgagccaccgcgcccggcctgaactctcagttctaacgcagggattcaggaattgggctttcggactccttctgcagtgtcacagtccagacttttttttaaatgaaggacaccccgcagtggctcacagtgggtcccagggctagcaggagcgtgctggggagccggctctgtctttgttcgcagtgggtcccggtgctggcaggagtgtgctggtgagccggctctgtctttgtaaatccttcaggggtcctacggctgactccaccggacagcccgtcctgggccgtgttaagcaccttttgtagaaatcgtatttttattaaaacatcaaatctgtgttcctgtaacagtgcagagtaataatatttctgaaccgttgggcacacaggagcgagtggaagccggcagagctgtccacgtggctgcaggggctgggccttggggcgcgtgtggctgtgaggccagttccagaaggagcctcaccatccctgggggtttgagtgctgggctgccctccatgggttcagcccttggcttcacgcttcctgctctgcaggatgggcctgcagggtcaggagacccacgtccccaggtcctgtgacagcgtgagctgctcatggaacagtgtgggacgttctccaggccagtggccctgccacctggtcatgctctccctgctctggggacctcagtgacttcttgggagtcccggggttaggggctgggaccctcgccgaggtgtcacccaggagggccagctcttctgaaagactcctcaggccgctgaggggaaagagcaccgagtactgccctagggagtcctggatgaggcagggccttcagcctgcagtccagcccacaggcagggcccagacgccctgagggatgtgtgatggcctggggccatggagagcagcccccagcccggacctctgggtgcctacctgcctcagcgtggcctggctgcaggagtgcgtggatggttccagcgccaggatagcagtgtggtgtcttggctcccgacccttctcagtggacagaagccatcccttaggtgctctgcccacactgggaccaggccctgtgggcacctcacaggcttctctgcggccctggctgctggtttgttcacactgagagtcctccctcggggcctcccttgacccctaggccctaattaatcagaggaaatgatggacccacagctggggtgggaggtgctccctcatggggacagcagcccaaagagctgtgaacaaaccaggtgcccttggtgaccccaggagccaccagttgtgtcctggaagctgggcctcccatgagacatgtccccctcagccatcagcagacagcaagggcggggaccctgccagcctagagcacacccaaccactagagggcaccctgatggcggaggttcagttgtgctgacagctggggtctctcatgggctcaccttatgggacggggaggcagccagggagcccctggtggggcagcttcagggactgtgccctgccatctggggtcgctaaggaagcacgctgaggaggagggggctggcccaccagcaccttcatgggccactgttctcccggtggcccagccctttggtccccagcacccattcaggatcccactgtgcccaccagaggtccaccagagccctgacaggagaggggccttgggtttgtagcagggacactgcccagccagcgctagggggcgctcccggcccgcgcttcgagccccatgctctgcctgccttggtgtggatgctggcactgcctgcctgttggcctggtccccccactgccctgcaggcctcagccttcaggcccatgtgggcctccccatcctgccactgtcaccaggcgtcccatggccaggcctgcctctggggcccagcatagggtttctgggcaagtgggggcattagggatgcagagtcccttgtaaggccacttccaccaggcctgcgcccacacgtgcttccctgaatggggttgagttaaacccttgcctgcccaggaaacgggccagcagtaccccctgacctgaaaggtgagtttgtagccagagcattttagaagctagagttcatgcagctcatggttgggaaaccctgctcttgagccagcagaggggaggagagcagagggaggacggcagaggggacagcagaggtagggagagcagaggggatggggggaggagagcagaaggaggacgacagaggtggggacagcagagatgggaaaaacgggaggacaagggagggaggatagcagaagggaggacagcaaagagggcggtggggagtcaggagagacggcacacctcctccaggaagccttcccagacttgctctcaccatgttgtcctcccatcctgctagggctatgaacttgggcaagggcctggttccatctctgggttctcagcacctcatctgcccaaaggtgctttatcactgtaggggaccctgatggagcccaaggcagtgggggcactggttgcccggcctgggagggcagagagctgatctggaggagagtgaccgcctgtgtagcccccagggccccatgagggctttgcttgcttttggctccatagagggatgcccagaaagctccccagctgactgggaaggcggatgccaggagtggggtgatgagagaaggtctgcctcagagctagtgagaaaggaccctccccaccaccaccaccacctcaggaacccacaagctgggagcagccagggcagtgcacccccaggcaccctgctcccttccgccaggcccctcccataaacattccttgctcttggggctcccagcccaccagtgactttcggtgctgctgccagcatccatcccgcgcaactgggaccacctggcaaagtgacccctccctcccctatcccagaactggagacagaaagcacagggccaggttagcaaccaggtgtctttatttttcggaaagttcgtcgctgggttaacaaaatcgcacctgccggtttgggtgacacctctggccaccatgcactgggccccaagaagagaccaccctgagccatggccctgcaggcaagcaagggacagctgcccagactcagggcccagtaacagtacagaacgaaccaactgaattcacggcttccctccaagctttgaaaggtagcagtccaggctataaaactctagaagcattgcgtaagaagtgttaagtctacaacaaatacatcttgtaaaaactcaataaattatatatatagatatatataaacttgtaacatctaataacatcggaacctgcacacagggccggcccctccctggaaaccgtctccctgcctgggacacacagcaattagaagaatttgtatgaaaataccagcttgctttgaagtccaaaaaataaatctcctaaagaaaaatcctatagaaatctaattctcctgaaaaaggacaaaggaaataaaatatcttcactggaatcacctccaactattaacaaccttttaggcttggaggggatcctccagctccggggcaggctggacgtacattcttggccgtccctctatcggcgggataaaccttctcggttgtcaataagttaaaaattaaaactctccgccatgtggccagctaaatgctggaagtgttggggtgtgggaacaagagtgccaggggcccataaatagctttacaaatatacaggtccagttttaaaacaaaactgcggtgccagaaaaagccctggtcctctgcttgcatgggtgagaccccctggggcctccctccacgcccccccacgccccgcccagggccatgcctgcctcctgtgcccccagggtcgcaggcctccgttgtaccagccttttcctcttccatatatgttatatatatatatgtatatataccatatacacagcatctatttatagaaatgtacactagtttccggaataaaccttttgcataaaaggtaaaggcaaaaaaaaaaaaaaaaaaaaaaaaaaaaaaaaaaaaaaaaaaaaaaaaaaaaaaaaaaaaaaaaaaaaa

SEQ ID NO: 127 - DNA, 60 bp, Homo sapiens
ggcttccagaggtttcagctttcagttatttgagaagtttgttttagatccttaactaat

SEQ ID NO: 128 - DNA, 2372 bp, Homo sapiens
cgaagctagggcggggcccgcgggctgaggcagcggctgtggcggcgacgctgggcgtgaggtggcggcggccgcgccctggttgggtccccactgctctcgggggcgccatggacgaggccgtgggcgacctgaagcaggcgcttccctgtgtggccgagtcgccaacggtccacgtggaggtgcatcagcgcggcagcagcactgcaaagaaagaagacataaacctgagtgttagaaagctactcaacagacataatattgtgtttggtgattacacatggactgagtttgatgaaccttttttgaccagaaatgtgcagtctgtgtctattattgacacagaattaaaggttaaagactcacagcccatcgatttgagtgcatgcactgttgcacttcacattttccagctgaatgaagatggccccagcagtgaaaatctggaggaagagacagaaaacataattgcagcaaatcactgggttctacctgcagctgaattccatgggctttgggacagcttggtatacgatgtggaagtcaaatcccatctcctcgattatgtgatgacaactttactgttttcagacaagaacgtcaacagcaacctcatcacctggaaccgggtggtgctgctccacggtcctcctggcactggaaaaacatccctgtgtaaagcgttagcccagaaattgacaattagactttcaagcaggtaccgatatggccaattaattgaaataaacagccacagcctcttttctaagtggttttcggaaagtggcaagctggtaaccaagatgtttcagaagattcaggatttgattgatgataaagacgccctggtgttcgtgctgattgatgaggtggagagtctcacagccgcccgaaatgcctgcagggcgggcaccgagccatcagatgccatccgcgtggtcaatgctgtcttgacccaaattgatcagattaaaaggcattccaatgttgtgattctgaccacttctaacatcaccgagaagatcgacgtggccttcgtggacagggctgacatcaagcagtacattgggccaccctctgcagcagccatcttcaaaatctacctctcttgtttggaagaactgatgaagtgtcagatcatataccctcgccagcagctgctgaccctccgagagctagagatgattggcttcattgaaaacaacgtgtcaaaattgagccttcttttgaatgacatttcaaggaagagcgagggcctcagcggccgggtcctgagaaaactcccctttctggctcatgcgctgtatgtccaggcccccaccgtcaccatagaggggttcctccaggccctgtctctggcagtggacaagcagtttgaagagagaaagaagcttgcagcttacatctgatcctgggcttccccatctggtgcttttcccatggagaacacacaaccagtaagtgaggttgccccacacagccgtctcccagggaatcccttctgcaaaccaaacgttacttagactgcaagctagaaagccaccaaggccaggctttgttaaaagaagtgtattctatttatgttgttttaaaatgcatactgagagacaaacatcttgtcattttcactgtttgtaaaagataattcagattgtttgtctccttgtgaagaaccatcgaaacctgtttgttcccagcccacccccagtggatgggatgcataatgccagcaagttttgtttaacagcaaaaaaggaagattaatgcaggtgttatagaagccagaagagaaactgtgtcaccctaaagaagcatataatcatagcattaaaaatgcacacattactccaggtggaaggtggcaattgctttctgatatcagctcgtttgatttagtgcaaaaatgttttcaagactatttaatggatgtaaaaaagcctatttctacattataccaactgagaaaaaaatggtcggtaaagtgttctttcataataaataatcagacatggtcccatttgcaggaaaagtgcagactctgagtgttccagggaaacacatgctggacatcccttgtaacccggtatgggcgcccctgcattgctgggatgtttctgcccacggttttgtttgtgcaataacgttatcacatttctaatgaggattcacattaatataatataaaataaataggtcagttactggtctctttctccgaatgttatgttttgcttttatctcacagtaaaataaatataattaatggtttgcatgtgaaattcacttttgaaagaacatgttaccttaccttttgttttagaagttttcaagtattaaaatattttttagaaaaaaaaaaaaaaaaaaaaaaa

SEQ ID NO: 129 - DNA, 60 bp, Homo sapiens
ggtcagttactggtctctttctccgaatgttatgttttgcttttatctcacagtaaaata

SEQ ID NO: 130 - DNA, 3441 bp, Homo sapiens
aaaaaaaaaatagtctcatcaaaactcttgtcaaggttggtcaccacacagaactgcctgtggaaaggccctgtagcaggaaaggatatggtacccagcacacttgaggaaccgaaagaagtccacgaagggaaagcagaggctgtgagctgttgggaggcaagcagggcgcatcacctagggccttctccgccaagtggggaagctgtctttatcctaagagcattgggaaactatcggaggctttaatcaggaaacgatgtcttaaagggaacggagtgcaagagtggacactgttaggtgccagttcagtggccaggtgaaaggtcatggtagctcacactaggatcggcagtggagacaaacaggcaggcgattacagtgtatctgggagagaacattccaacaaatcgtaggtggtggcgttgaattatagtgatgattactgtggccactcacacagtacagacatctgccccccagataatttctaggaagtggaattcaccatcttcattttacaggtggggtaacagcagttcaaagaaaggaacttgagcccagacatttgccatgtcaagagctggagcctctggaaagagaagggagctggtgcttcctcagtggtggtggaggaggggcattcttatgccaccagctttattctgtgtggattccagggacttccatgttgccaaatccaaagcaatctctttgctgcattgtcttactctgtcccagcagtaattgacagttaccactctccggaagtggtctgtcatcttgcttcccgggcactgtgctctcctgttttctatcagcttctctagccactccttccctgtcttctttgctgattcctcctctgttccttggggctgatcctgggccacttttctctctgagccctctcctcaggtgatctcttccattctcttggtattacatagcatccatgtgttggtgactcacaaattttttttgagcccagacatgtcccatgtgttccaactcgaggttctaactgcccctgtgacatctgacaaacatctccagcttcatgtgttcaaaagggcaagggttgattggaccatggtactgttctccctcacctgcccaagaaggctatccccactcacccccgctcatcttgccttgtaaagggcatcaccacctatatctgctccaggcagaaaccacacgctccccagtcctgcatcaatcctgcctcctccatctccatgatgcctcttaactccctccacctctccatctccatggccaccacctgctctcacctggcgtcctcctccttggtcttctccttctacttttattcttgtcaactccattagacacagccagaggccacctcctaaaataggagctgacttatgtcccttttctcattaaaactcttcagtggcttcacatggcactgagaagaaaactcaggctccttcccagccctgtgcacatgtcccctgcatgtctccccacttcctctcctaccctgccctccttaggccctggcctccctcatcttctcctggttcccggagcacactgagctcttttccttcacaaggccttggagcatgctgctccatctgcctggaaacctctccctcaagactcagtacatgagtcacctccccacagacgcttcccctgaccctctgtgttggtctgctctggctctcataagaaaataccagagactgagtggcttaaacaaaagacatttattttctcacagtcctggaggctggaagtccaagaccaaggtgttcgcagggttggtttcttctaaggcctctctccttggcttggagatggccctggttggtcttctgagtgcaggtgtccctggtgtctctttgtgtgtccagattttctcttataaggacactggtgagattggatgagggggcccctgacggcctcatcttaatgtaatcacctctcttatctccatatccattcacatacgggccattgcgagctaccggggattaggggttcaacacataaattgggggtgggggggtgcagctcagcccataaacatgccccctctggctcgctctcccagggcatccatcgtagcacttagaaaaatgatcacttcttcttttttggctttgtggtggcgtgtgtgtgtgtgtatttgtatatacacacatatatatataaatacacagacacacatatatacaaacacacgcattcattttcgtccacagttcctggctcataactcccacagcccttgttacactcttttgttacaacattgggtgtgtcaggcctcaggagacaatcactctaacctcctgcccttccttttacctgcccaagacaggactctaatcttccctacctttctgatggtgggtcataaaactcattccagagacggtcccaccccatatcctgctagaaggaatgctgctgtcatgaagcttccataaaaaccaaggggactggattcagagagcttccagataactgaacatacagaggttctagaagggtggtgcgcccagggagggcacaggaagctccatgcccttccttcatacctcaccctatgcatctctttatctgtatcttttataatatcctttataataaaccagtaaatgtatttcccttagtttcgtgagccaccacacccagcctgaatacattttagagtgcctagcctattaaacttttttttccagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgtt

SEQ ID NO: 131 - DNA, 4367 bp, Homo sapiens
ggcgctcgtttggcgcgcgcgccctaggcggcggatctaagctaacttcttggatcttttcttgtttctccttggtttttgactttttctggaccctggtgtctacgatttccgagatgccgtcttctttgttgggcgcggcgatgccggcctctacatctgccgcagccctgcaggaagctctggaaaatgctggacggctcatcgaccgtcagttgcaagaggaccgcatgtacccggacctttccgagctgcttatggtgtctgccccaaataatcccaccgtttctggcatgtcagatatggattatcctttacaaggacctggtttgctgtccgtacccaaccttccagagatcagttccatccgaagagttcctctcccacctgaacttgttgagcagtttggacatatgcagtgtaattgcatgatgggtgtgttccctcctatcagcagagcttggctcacaattgacagtgatatattcatgtggaactatgaggatggaggagaccttgcctattttgatggacttagtgagactattcttgctgtggggcttgtgaagccaaaagcaggcatctttcaacctcatgtgcgacacctcctggttttggcgacccctgtagacatagtaattcttggactcagctatgctaatttgcaaacaggttctggagttcttaatgatagtttgtctggtggaatgcagttgcttccagatcctttatattctcttcctactgataatacttaccttttaacaataacttccactgataatggcagaattttcttggctggaaaggatggctgtttatatgaagtagcctaccaggctgaagcagggtggtttagccaaagatgtaggaaaataaaccactcaaagagctcactttctttccttgttccttccttgctacaattcacgttctcagaagatgatcctattcttcaaattgcaattgataattctagaaatattttatatacacgatctgagaaaggagtaatacaggtgtatgatttgggacaagatggacaaggaatgagcagagttgcctctgtgtcacagaatgccattgtctctgctgctggtaacattgctaggaccatcgatcgttctgtttttaaaccaattgtccaaatagcagtgattgaaaattctgaatcactggactgtcagttattggctgtcacacatgcaggtgttaggttatattttagcacttgtccattcagacagccattagcacggcctaatacactgacgctggttcatgtccgcttacctcctggattctcagcatcttcaaccgtggaaaagccttcaaaagtacatagagctctttatagtaaaggtattctattgatggcagcctcagaaaatgaggataatgatattttatggtgtgtcaaccatgatacttttcctttccaaaagccaatgatggaaacccagatgacagctggtgttgatggtcattcctgggctctttctgcgatagatgaattgaaagtagataaaataattacacctttaaacaaggatcatattccaataactgattcaccagttgttgtacagcagcacatgttacctccgaagaaatttgttctcctctcagcacaggggagccttatgtttcataaacttagacctgtagatcaactgaggcatctacttgtgagtaatgtgggaggagatggagaagagattgaaagattctttaaattacatcaggaagaccaggcttgtgcaacttgccttattcttgcttgctccactgctgcctgtgatagagaagtatctgcctgggctactcgggctttctttaggtatggtggtgaagcacagatgagatttccaaccactcttccgcctccaagtaatgttggtcccatcttggggtctcctgtctattctagttctcctgttcctagtggtagtccctatccaaatccatcctttttgggaacaccgtctcatggtatacagcctcctgccatgtcaactccagtgtgtgctctgggaaacccagcaactcaggccacaaatatgagttgtgtgactggaccagagattgtgtactctggaaaacacaatggtatttgcatttacttttctcggatcatgggaaacatttgggatgcaagcttagttgtggagagaatattcaagagtggcaacagagagatcactgcaattgaaagtagtgttccctgccaactgctagagtcagtgctacaagaactaaagggtttgcaggaatttctagacagaaactcccagtttgcaggaggaccattaggaaatccaaatactactgctaaagtgcagcagaggctgataggattcatgcgtcctgaaaacggaaatccccagcaaatgcaacaggaactgcagaggaagtttcatgaggctcaactaagtgaaaagatttcacttcaggcaattcagcagttggttcgaaaatcatatcaggctctggctttatggaaacttctttgtgaacatcaattcactatcattgtggcagaacttcagaaggaacttcaagagcagctgaagatcaccacctttaaagatcttgtaatcagggacaaagaactcacaggggcattaattgcttctcttatcaactgctacatcagagataatgccgctgttgatggcattagtttacatttacaggatatctgcccacttctatatagcactgatgatgcaatttgttctaaggcaaatgagcttctccagcgttcccgacaagttcaaaataagactgaaaaagaaagaatgttaagggaatcattaaaggaatatcaaaaaattagcaatcaagtggacctttccaatgtttgtgctcagtatagacaagtgagattttatgagggtgtggtggaactttctcttacggctgcagagaaaaaagatcctcaaggtcttgggcttcatttctataaacatggagaaccagaagaagacatagttggacttcaggccttccaagaaagattaaacagttacaaatgcattacagacacacttcaagaactggtaaatcaaagtaaggccgctcctcagtctcccagtgtacccaaaaaacctggtcctccagtgttgtcatctgatccaaatatgctgagtaatgaagaagcaggacatcattttgaacaaatgcttaaattgtcacagcgatccaaggatgagctctttagtattgccctttataattggctaatacaagtcgaccttgcagataagctgctacaggttgcttctccatttctggagccacatctagtccgaatggccaaagttgatcaaaacagagttcgttatatggatttactctggcggtattacgagaagaacagaagtttcagtaatgctgctcgtgtactgtccagactggctgacatgcatagcacagaaatttcacttcagcagcgactagagtacattgctcgagccattcttagtgccaaaagttccactgccatttcatcaatagctgccgatggtgaatttcttcatgaattagaagaaaaaatggaggttgctaggatccaacttcagatacaggagacactacaaaggcagtattcccatcattcttctgtacaggatgcagtttctcagctggattctgagctgatggacataactaagctttatggggaatttgctgacccatttaaacttgcagagtgcaaacttgcaataattcattgtgccggttattcagaccctatattggtgcagacactttggcaagatatcatagagaaagaattgagtgacagtgtgacattgagctcctcggatagaatgcatgctcttagtctcaagattgttctccttggcaaaatttatgctggcacaccacgcttctttcctttagattttattgtacagtttttagaacagcaggtttgtactttgaactgggatgtgggcttcgtaatacagacaatgaatgaaattggagtaccattacctagactactagaagtttatgatcagttgttcaaatcacgggatccattctggaacagaatgaagaagccactgcaccttttggattgtatacatgtattattgataagatatgttgagaatcccagccaagttttaaattgtgaaaggagaagatttacaaatctctgcctggatgctgtttgtggttaccttgttgagctccagtctatgagctcgtcagtagcagtacaagccatcactgggaattttaaatctcttcaagctaaattagaacggcttcattaattactgtgatatactttcatccgttttatgatctgtaaaataaaaactcagctgggtccaaaaaaaaaaaaaaaa

SEQ ID NO: 132 - DNA, 60 bp, Homo sapiens
gccatcactgggaattttaaatctcttcaagctaaattagaacggcttcattaattactg

SEQ ID NO: 133 - DNA, 3579 bp, Homo sapiens
tcaggctcgctgtcgcgccattttgccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggccactattgaactctgcagtacccatgcaaatgatgcctctgccctgaggattctgttttcttccctgatcctgatctcaaaattgttctatagtttaaactttcaggatctccctgaattttttgaagataatatggaaacttggatgaataattttcatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaaccttgagcaaattagttggtttgtgtgatcatacagttatgtgggtggcttctagtttgcaacttcaagggacaagtattaatagttcagtgtatggcgttggtttgtgttgagcgtttgcacggtttggataatcttaaattttgacggacactgtggagactttctgttactaaatccttttgttttgaagctgttgctatttgtatttctcttgtcctttatattttttgtctgtttatttacgcttttattggaaatgtgaataagtaaagaattacttgtgttacttgccaagcagtgcacatttcatagtttcaaatctgtaatcagcaataaaaatcctaaaatatgtacctaaaaaaaaaaaaaaaaaaaa

SEQ ID NO: 134 - DNA, 60 bp, Homo sapiens
gttacttgccaagcagtgcacatttcatagtttcaaatctgtaatcagcaataaaaatcc

SEQ ID NO: 135 - DNA, 4698 bp, Homo sapiens
aggggatgtaacggtcgcccgcctccggcgtgacgatggcggccgtagggtccggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgtcactcgagaaggtgcttggcatcacagcccagaacagcagtggcctaacctgtgaccccggcacaggccatgtggcctacctggcaggctgtgtggtggtgattttggaccccaaggagaacaagcagcagcacatctttaacaccgccaggaagtctctcagtgctctggccttctcccctgatgggaagtacatagtgacaggggagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccagcttcctcttccacaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggtgtatcctgagtttgaagaccagagagcttgtttgccatcaggatcctttctgacttgttcttcagacaacaccattcgcttctggaacttggacagcagccctgattctcactggcagaaaaacatcttcagcaataccctgctgaaggtcgtgtacgtggagaatgacatccagcacctgcaggacatgtcacacttcccagaccgggggagcgagaatgggacacccatggatgtgaaagccggggtgcgggtcatgcaggtcagtcctgacggccagcatttggcttcaggcgaccgaagtggaaatctgaggatccacgagctgcacttcatggacgagctggtcaaggtggaggcccatgatgctgaggtgctgtgcctggagtactccaagccagagacggggctgaccttgctggcctcagccagtcgggaccggctgatccatgtgctgaacgtggagaagaactacaacctggagcagacgctggatgaccactcctcctccatcaccgccatcaagttcgctggcaacagagacatccagatgatcagctgtggggctgacaagagcatctactttcgcagtgcccagcagggttcggatggactacactttgtccgtacccaccacgtagcagagaaaaccaccttgtatgacatggacattgacatcacccagaagtacgtggccgtggcctgccaggaccgcaatgtgagagtctacaacactgtgaacgggaagcagaagaagtgctacaagggctcccagggtgacgaagggtccttgctgaaggtccatgtggacccctcaggcaccttcctggccaccagctgctctgacaaaagcatctcagtgattgacttttactcgggcgagtgcattgccaagatgtttggccattcagaaattattaccagcatgaagttcacctatgactgtcatcacttgatcacagtatctggagacagctgcgtgttcatctggcacctgggcccggagatcaccaactgcatgaagcagcacttgctagagattgaccaccggcagcagcagcagcacacaaatgacaagaagcggagtggccaccccaggcaggatacgtatgtgtccacacctagtgagattcactccctgagccctggagagcaaacagaggatgatctggaggaagagtgtgagccagaagagatgctgaagacaccatccaaagatagcttggatccagatcctcgttgcctgctaaccaacggcaagctgccactgtgggcaaagcggctgctaggggacgatgatgtggcagatggctcggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgaggactcgggggagtcagaggccgacctggagtgcagcttcgcagccatccactccccagctccgcctcctgaccctgcccctcggtttgccacgtcgctgccccatttcccaggatgcgcaggtcccacagaagatgagctgtccctgcccgagggacccagcgtccccagcagctccctaccccagactccggagcaggagaagttcctccgccaccactttgagacactgactgagtccccctgcagagagctcttccccgcagctctgggagacgtggaggcctctgaagctgaagaccacttcttcaacccacgcctgagtatctccacgcagttcctctcaagcctccagaaggcatccaggttcacccataccttccctccccgggcaacccagtgccttgtgaagtctccagaggtcaagctcatggaccgaggcggaagccagcccagagcaggtactggctacgcctccccagacaggacccacgtccttgctgcagggaaggctgaagagaccctggaggcctggcgcccaccacctccctgccttacgagcctggcgtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgctgccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcagcactgcctccctcctggagcccacctccggtgcacttggtctgttccagggcagccctgcccgctggagtgagccctgggtgccggttgaagccctgcccccatctccccttgagctgagcagggtggggaacatcttgcacaggctgcagaccaccttccaagaagccctcgacctttaccgtgtgttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcagcccctccaccgcagccctgctgcttctgaggacttaggtattttaagcgaataaactgacagctttgaaaaaaaaaaaaaaaa

SEQ ID NO: 136 - DNA, 60 bp, Homo sapiens
ccgcagccctgctgcttctgaggacttaggtattttaagcgaataaactgacagctttga

SEQ ID NO: 137 - DNA, 3224 bp, Homo sapiens
agcggtaaatttgaaatggctgacgggtcgctgacgggcggcggtctggaggcagcggccatggcgccggagcgcacgggctgggcggtggagcaggagctggcgtctctggagaaaggtttgttccaagatgaagattcatgcagtgattgtagctaccgtgataaaccaggttctagtttacaaagttttatgccagaaggaaaaacctttttcccagaaattttccaaacaaatcaacttttgttctatgagcgattcagagcctatcaagattacattttagctgactgcaaggcctctgaggtacaggaattcacagctgagttcttggagaaggtccttgagccatctggatggcgggcagtctggcacactaatgtgttcaaggtgctggttgagatcacagatgtggactttgcagccttgaaggcagtggtgaggcttgctgaaccatacctctgtgactctcaagtgagcacttttaccatggagtgcatgaaggagctccttgatctgaaggagcatcggttgcccctgcaggagctgtgggtggtgtttgatgattcaggagtgtttgaccagacagcccttgcaattgagcatgtcagatttttctaccaaaacatttggaggagttgggatgaagaagaggaggatgaatacgattattttgtcagatgtgttgaacctcgattaagattgcattatgacattcttgaagaccgagttccatcaggacttattgttgactaccacaatctgttgtctcaatgtgaggagagttacaggaaatttttaaatctgagaagcagtttgtcaaattgtaactctgattccgagcaggaaaatatctccatggtggaagggttaaaattgtattcggagatggaacagttgaaacaaaagctgaaactcattgagaatcctttgttgaggtatgtgtttggttatcagaagaattctaacatccaagcaaagggtgtccgttccagcggtcagaagatcactcatgtggtctcctccaccatgatggctggtctcctgcggtccctgcttacggacaggctttgccaggagcctggtgaggaagaaagagaaattcagttccatagtgatccattgtctgctataaatgcctgcttcgaaggtgacactgttattgtttgtcctggccattatgtggtacatggcactttctccattgctgactccattgagttggaaggatatggcctaccagatgacattgtgatagaaaagaggggcaaaggcgacacttttgtggactgcactggtgctgatattaaaatctcaggcataaaatttgttcagcatgatgctgtagagggaatcttaattgttcaccgtggtaagactacgctggaaaactgtgtgctgcagtgtgagacgaccggagtcacagtgcggacatcagcagagtttctaatgaagaactcggatttatatggcgccaagggtgctggtatagaaatctaccctgggagtcagtgcaccctgagtgacaatgggatccatcactgcaaggaagggatcctcattaaggacttcttagatgaacattatgacattcccaagatatccatggtgaataatataatacataataatgaaggttatggtgttgtcttggtgaaacctacaatcttctctgacctgcaagaaagtgctgaagatggaactgaagaaaataaagcgcttaaaattcagacaagtggagagccagatgtggctgaaagagtggatctagaagagctgattgagtgtgcaactggtaaaatggagctttgtgcaagaactgacccttctgagcaagtcgagggaaattgtgaaattgtaaatgaactaattgctgcctccacacagaaaggccagataaagaagaaaaggttgagtgaactggggatcacgcaagctgatgacaacttaatgtcacaggagatgtttgttgggattgtggggaaccagttcaagtggaatgggaaaggtagttttggcacatttcttttctgactacagtgatgtaagtagatagcaaaatactggattttgcacatgctgccctaagaatcactgctgccattgtagtttgctgtattgtctgtattttatatttgattatttgggcttgagtgaaaggtagatttatttccatttgcaggtgttgcacataaaacactccctctttataagaaaaatcataaatgcatataaaatagaaaatatttggagattgcttatctgaaagtcttgctttcttatacacatggttctctcatattaagcctggtggtaactttttagtgtaattacctttagcacttcaaagacgaggaagtaaggaagggaatgcaagactagtgcataaaaatgcaataggtgtcatatgtacagcattcttcttagagttgccttttcatcccaattacagtgagtctgatttccatcctgtatttgcataatacttgtcttaaaataaaagcttttatgattgggaatttatctgcctaatcagacttattattgagacgtcaatgggacgcatttttctgttgagctatgcagtcgtcaaaacagcgatagacagcataggaggtttgaagcagaaatgaaatgtgttattcagagccaatgttgtacatagagcattttcactattgctgaatgggaatgattaaaaacaaggtatttttcgggccaggcggtggctcacgcttgtaatcgcagcactttgggaggctgaggcaggaggatcacttgagcccaggagttcaagactagcctaggcaacatagtgagaccctgtctctactaaaaataaatttaaaaaaaattagctgagtgtggtggtgcatgcatgtagttccagctactcaggaggctgaggctagaggatccttgagcccaggaggttgaggctgcagtgaggtgtgattgcgccactgcattccagcttgggcgacagagcgagacccagtctcaaaaaaaaaaaaagtatttttctcttaccgttacagtattctgattatattactgacacagtcaaaatgattaactgtacaacctgtatctgctgggtgttcttgttatcatattgtaaaacagctttaaaaatatttatattttaaaaactgtatgtgacattaatatgcctaatgattaaaattatagtgatgaaataacaaagaaaaaaaaaaaaaaaa

SEQ ID NO: 138 - DNA, 60 bp, Homo sapiens
aatgattaactgtacaacctgtatctgctgggtgttcttgttatcatattgtaaaacagc

SEQ ID NO: 139 - DNA, 1946 bp, Homo sapiens
tggccgcctctgctcctcccgaccgcagcccctacctctctcccagactccagtcgcccgtgcccaccgctgcccacgtggcctctttccaggcagcagccagggcttctggcacgtcgggcgccagcactgtcgcttgtggccacggcccgcagagcttcagtcccttgagctcctcctccagagcagggccgagggtctcgccccagcccgactggctgtgcctgcagatgatgctggtcacgcagcttttcgtttcccggaacgcaggtgggatagcagtgcccttttctggcagtgcggcattctctctggcagtcattccgcccggagaggctcatcttgggcggttctgggcgacagctgtgtggctgcacagtggccagtgagaggcatctgggaaggtggcccttgtgtagggagtcactctccttccgtcacggtcacacctcatgaaatggttagattcttccaagtgccttctacgcccctggcagattttctagaatttgccgtcccagaagcttgagaagtgtccagtgccacccgacagcagaagccgggatgccgctgagacgccagcgcttctgagtccctctcactgcctgccttctggtggagagaaggctgtcctgcgggcttatgccctccccacgctcctcgcaccgttcacgccattgtgcagcacagctgttaggaccaaattcatcttccccgcaaggacgagtcaggcccagtgttgcactggtcctgctgtctggcttctgctgcggaacttcctcaccttccaggcagggcccaggagccacaggagcgtgggcggggcagggtctgccctctgtgcttccgactcgccgcttgtgagctggagggacagtcacctcgacctggtgggctgggtgggcctggctgtgctgtgggctgtgcctcactcctgcaagtgggcactcagcggggttggggtcacgaggctgaggtcggcttaaagcaggagtgggcagttggcacgtcatgtttctcctgcatcagggctgtggcaggaatgccgggtgactaccgtagacacttgtcaaggctgaggttcagagaaaggtgtggggtatcccggaggtcaccacagtgtgccaggaggttcaggttggccttccagagcccggcctgtgtgaaatccccacgagcacagaggacagaacgaaacatggtgttgttttgagacagggtgttactgtgtcacccaggctggagtagagtggtgccacattttttgtagagacggggtgtccctgtgtagcccaggctggtcttgaactcctgggtacaagcagtcctccctcgtgggcctcccaaagtgctgggattacaggcgtgggctcccgtgaccagcctggaacgtgctgatgagcctctttttctcctgaaaccccggtgggaacagatggtggatgcttccaaaagcatcgaagctgtccatgaggacatccgcgtgctctctgaggacgccatccgcactgccacagagaagccgctgggggagctatggaagtgacccaaggctgccactggagacgcctctccctgcagtcccccgagaggtgggagactcgcggaaggccctgtccccagcggagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaacgacctgaaaattgaaaaaaaaaaaaaaaaaa

SEQ ID NO: 140 - DNA, 60 bp, Homo sapiens
cttactgaagttcagtgataactctgagcagtttcattgtgatcactgtaaatggtaatc

SEQ ID NO: 141 - DNA, 2580 bp, Homo sapiens
gcattgcgcagacgaccagcgggcgcctcggattccgcccccgggatggccccgcctcctcccgccccgcggcaaggcacgcacagggcagtgcgcgggtgggtgggtcctagcagcgcggcctgacgggaccaaggcggcgggagtctgcggtcgttccctcggctgtggaccgggcggcacgcacgcggtgcagggtaacatggcggatgcggaagtaattattttgccaaagaaacataagaagaaaaaggagcggaagtcattgccagaagaagatgtagccgaaatacaacacgctgaagaatttcttatcaaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtactctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataaccacaaggatgagagttacctgcggcgatttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaaaaaaaaaaaaaaaaaa

SEQ ID NO: 142 - DNA, 60 bp, Homo sapiens
aaccctaaataagtggtagaagagtgtcactgaattttgtctctgaattcagtataactg

SEQ ID NO: 143 - DNA, 1924 bp, Homo sapiens
tcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggtatgtacaagatgagagcgagcctttcagaagccagggtctggtcctggctcctcttactgagatacagggcagcactggcagagagcagacttaaggaaacctgtaaggaggtaaggatgttccctgtctctgccctccctctgagcaggactctcagaagaaagacaagctgctctgcagccagcttcaggtagcggatttcctgcagaacatcctggctcaggaggacactgctaagggtctcgaccccttggcttctgaagacacgagccgtgagtaggcaggggattgtagtagcagctgacctgagtggggaaggaaggaggatttcagttaggtctcccatttggctgatgggaaggaggcccagtgttgcagggaggcaggctagcaggccaccctcactcatgtactcattcctggtggctcatctcaggacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacagggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgtttt

SEQ ID NO: 144 - DNA, 60 bp, Homo sapiens
ctagtgataccttgatctttcccactttctgttttcggattggagaagatgtaccttttt

SEQ ID NO: 145 - DNA, 3300 bp, Homo sapiens
gactgctcttattttaattattgcagacggaagttgaagactattgacatagtaaatagctctgggtggcttgaaacgaaagtttaactttgcggacaaacaggacttattgtagggggtggtcaaaatagtcccggcggggcggggccatgacccctgacgtcgccggtccggcgcgcagttcagtttggcggttccggtaccgctctcacattggggcgggatgtgggagcggctgaactgcgcagcagaggacttttattctcgtctccttcagtgtcctgcagagataaagtgatgactgactcctgagtgtgaataacgggagagataatgtagttctgtttttcacatgtggttctgcgtttcaggaaatttaatgaagaaaagaaaggaatccgtaaagacccatttctctatgaggctgatgtccaagtgcagttgatcagcaaaggccaaccaaaccctttgaaaaatattctaaatgaaaatgacatagtattcatagtggaaaaagtgcctttagaaaaggaagaaacaagtcatattgaagaacttcaatctgaagaaactgccatatctgatttctctactggcgaaaatgttggaccacttgctttaccagttgggaaggcaaggcagttaattggactttacaccatggctcacaatcctaatatgacccatttgaagattaatctgccagttactgcccttcctcccctttgggtaagatgtgacagttcagatcctgaaggtacttgttggctaggagctgagcttatcacaacaaacaacagcattacaggaattgtcttatatgtggtcagttgtaaagctgataaaaattattctgtaaatcttgaaaacctaaaaaatttacacaagaaaagacatcacttgtctactgtaacatccaaaggctttgcccagtatgagctctttaagtcctctgccttggatgatacaatcacagcatcacaaactgcgatcgctttggatatttcctggagtcctgtggatgagattcttcgaatccctccactctcttcaactgcaactctgaatattaaagtggaatcaggagagcccagaggtcctttgaatcatctctacagagaactgaaatttcttcttgttttggctgatggtttgaggactggtgtcactgaatggctcgagcccctggaagcaaaatctgctgttgaacttgttcaggaatttctgaatgacttaaataagctggatggatttggtgattctacaaaaaaagacactgaggttgagaccttgaagcatgacactgctgcagtcgatcgttccgtcaagcgtcttttcaaagttcggagtgatcttgattttgctgagcaactgtggtgcaaaatgagcagtagtgtgatttcataccaagacttggtgaagtgtttcacattgatcatccagagtctacaacgtggtgatatacagccatggctccatagtggaagtaacagtttactaagtaagctcattcatcagtcttatcatggaaccatggacacagtttctctcagtgggactattccagttcaaatgcttttggaaattggtttggacaaactaaagaaagattatatcagttttttcataggtcaggaacttgcatctttgaatcatttggaatacttcattgctccatcagtagatatacaagaacaggtttatcgtgtccaaaaactccaccatattctagaaatattagtcagttgcatgcctttcattaaatctcaacatgaactcctcttttctttaacacagatctgcataaagtattacaaacaaaatcctcttgatgagcaacacatttttcagctgccagtcagaccaactgctgtaaagaacttatatcaaagtgagaagccacagaaatggagagtggaaatatatagtggtcaaaagaagattaagacagtttggcaactgagtgacagctcacccatagaccatctgaattttcacaaacctgatttttcggaattaacactaaacggtagcctggaagaaaggatattctttactaacatggttacctgcagccaggtgcatttcaagtgaagtgtgctgatgaagtcctctataagcacaagccaaaaagagaaagagaaaaaaaggtaattattgtagaacctgaaaacagcaatgtatggaaaccctcaaagcagaaaagggaggaagatcctgaagattctcttatgaagctccaaaattgataatcctgtctcagctctgcctcctcaggaggagcattagtagaacagcagtgatgaggacacagagggagcagacagtgggtaccacgatctccgtaaccatttgcatgtgacttagcaagggctctgaaatgacaaagagaacgagcaccacaaatgagaacaggatcattttagtaaatacagctttatcccaaaagctttaactgtattgggaaaacttaaaaaatagcatcctcaaattttctgattcttatttgccatgaaatagaacttagtaaattaaatgttatttgaaaatgttataagagctttgtaaatatttcagaaaatatgggataaatgcctgaatttggttcttctacaggtgctataataaagtccatctctcaatacttatactttctaaattcatctcagaatattagcagccatattccacagttcctataatttttactgggggggatttgtgataggaaagtccttgggaaacatttccaatctttcaaaatattattgtgtatcttaagaagtataggaacttgtatgttgaaatgttgtatggtagttcttgtatagttaaataataatctttttaagagttaatgataagcatatgttatgtgcattattaataaaatagtggccacttaggtaatacccacttttatcttgtgtgctgggtactctggttactgagataaataaggcactggacatcctcacgtggagttcacaggctcatcagtgaattctgtaccacatttcaaccttgtttattttagtttaatggaatatacattcttagtattgcctgattatttaaatttgttgagggggattgcatgttgctttattggcctgtaaaaatagctagtttggtaagatttggtctcgcaccttccatctttgctaccacattaaagatgagcttgttaaaaaggaaagcatatttctctgattgcccttatggagaaataaagataaaattcaaagaaaaaaaaaaaaaaaaaaaaaaaaaaaaaaaaaaaaaaaaaaaaaaaaaaaa

SEQ ID NO: 146 - DNA, 60 bp, Homo sapiens
tttttaagagttaatgataagcatatgttatgtgcattattaataaaatagtggccactt

SEQ ID NO: 147 - DNA, 3692 bp, Homo sapiens
gagcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaggagcagaggcagcgagttgtggaaagcctctgctgccatggtgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctctttaccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttaaaaaaaaaaaaaaaaaa

SEQ ID NO: 148 - DNA, 60 bp, Homo sapiens
atgaaagtttgcactgtatgctggacggcattcctgcttatcaataaacctgtttgtttt

SEQ ID NO: 149 - DNA, 1208 bp, Homo sapiens
  misc_feature 1, 9, 14, 15, 16, 17, 18, 19, 21, 29, 30, 58, 62, 63, 64,69, 70: n = A,T,C or G
  misc_feature 1, 9, 14, 15, 16, 17, 18, 19, 21, 29, 30, 58, 62, 63, 64,69, 70: n = A,T,C or G
nttcccccnccccnnnnnntncccccccnntcttcttcttccccccctcttctttcangggnnnggaannctacaaaaccggccccagaatctggcacgttgccggggacctagggacagacgaccgcacaacacgccacgttgcaggcgctgccaggccgggtgcctcacctagctccttcatgtattcatcaaagcctttgctgtccaccaggcgccatcttccttccagctgctgaactgtggccatggtgggtgcgggcgggcctggcggtgcacaaaaagcaaaagggggtcttgccgtcaggcggggccaaacctgccggtgtaaggcaccccgggatgcccggcggccggccttttaaaaaggggggggcccccccgctgtggtcccgccctctttgccgcccccaagggggaggggggccccctccccccggatttccttgccccttcccccccggccccccgaggtctcttccccccccctcaaacttctccgaacacccccccccttcacagggcccccaaccccccccttcccacaccccccccacaacaaaaccaagttcctccccatcccacctcctttccgcccctactaccacgcctgcggcaccacaccttccttattgcccatccctaccacccgtctctatccccctctcctctccttgccactgaccggcacaccgactctccagatgctgaaccccctccgtccctccgcctgcgctccccgcccgggccggcgcgcgctcctcctccttttcccctctctcccctccgtctgcccttttttcccccgaccactactgatccgatctccccccacactccccctgtcatctccccataccacgccccttcccacaccattacttcccccatgcaccacacgctagcctcgataaccagcatcacccgcgcgtactattaccaacttcctgctgcaccgaccacgccatcgacccctacttcagcagcactccacccaactcctctcaccctccctgctcgatctccggcgactgtatcccgccacccccaccccacaccgatcccacttcatctcacccctatctgttctacccctatatcccgtgcccgctccgctgtccctactctctttctctcccgacaccatcatacccaccttcatcaagtctgcacaccacctcttacaacctcctcttttatcacactcc

SEQ ID NO: 150 - DNA, 3274 bp, Homo sapiens
catggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagaggttggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataaacttgctatggagagactctatgcagtttttacagattacgagcatgacaaagtttccagagatgaagctgttaacaaaataagattagatacggaggaacaactaaaagaaaaatttccagaagccgatccatatgaaataatagaatccttcaatgttgttgcaaaggaagtttttagaagtattgttttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgagtttcctccttatgcaactaatgaaattggcaaagtcactggtttaaatagaagagaacttgggcatggtgctcttgctgagaaagctttgtatcctgttattcccagagattttcctttcaccataagagttacatctgaagtcctagagtcaaatgggtcatcttctatggcatctgcatgtggcggaagtttagcattaatggattcaggggttccaatttcatctgctgttgcaggcgtagcaataggattggtcaccaaaaccgatcctgagaagggtgaaatagaagattatcgtttgctgacagatattttgggaattgaagattacaatggtgacatggacttcaaaatagctggcactaataaaggaataactgcattacaggctgatattaaattacctggaataccaataaaaattgtgatggaggctattcaacaagcttcagtggcaaaaaaggagatattacagatcatgaacaaaactatttcaaaacctcgagcatctagaaaagaaaatggacctgttgtagaaactgttcaggttccattatcaaaacgagcaaaatttgttggacctggtggctataacttaaaaaaacttcaggctgaaacaggtgtaactattagtcaggtggatgaagaaacgttttctgtatttgcaccaacacccagtgctatgcatgaggcaagagacttcattactgaaatctgcaaggatgatcaggagcagcaattagaatttggagcagtatataccgccacaataactgaaatcagagatactggtgtaatggtaaaattatatccaaatatgactgcggtactgcttcataacacacaacttgatcaacgaaagattaaacatcctactgccctaggattagaagttggccaagaaattcaggtgaaatactttggacgtgacccagccgatggaagaatgaggctttctcgaaaagtgcttcagtcgccagctacaaccgtggtcagaactttgaatgacagaagtagtattgtaatgggagaacctatttcacagtcatcatctaattctcagtgattttttttttttaaagagaattctagaattctattttgtctagggtgatgtgctgtagagcaacattttagtagtatcttccattgtgtagatttctatataatataaatacattttaattatttgtactaaaatgctcatttacatgtgccatttttttaattcgagtaacccatatttgtttaattgtatttacattataaatcaagaaatatttattattaaaagtaagtcatttatacatcttagaaaaaattacatagttttgtttttacaattctgaaatatatgaaaaacttagatagaatatgtcatatgttattataacagatctcttcctacatcttatttttcttctttgtatacagtagtgacagtttaccttcagtcatcctacaggtcacctctgtgcccaacaactttacttgcctacaacggttcacaaactggaacaggccatattcaaagccagtgcctatttcttcagaactgttaacagatatagtgagttgagggagctaatctgatacacttttgataatataatgcctttcaaattagttaccaaatcataaacagagtggaataaatataaattagattctaactaggatgaatgtggtagtaatgatgtatatttttcaaatttacctaaacagaaagattattggctaaggcaggcggatcatgagatcaggagatcgagaccatcctggctaacacggtgaaaccccgtctctactaaaagtgcaaaaattagccgggcgtggtggcgcatgcctgtaatcctagctactcaggaggctgaggcagaagaatcacttcaacccaggaggtggaggttgtagtgagccgagattgcgccattgcactccagctcaggcaacaagagcaaaactccgtctcaaaaaaaaaaaaaaa

SEQ ID NO: 151 - DNA, 60 bp, Homo sapiens
tgtctagggtgatgtgctgtagagcaacattttagtagtatcttccattgtgtagatttc

SEQ ID NO: 152 - DNA, 3424 bp, Homo sapiens
tgggtggcggcggcggcagcgggttcggttgcgcgtggcgcacggggtgggagcggagcccaggccgggagcaggcgccgccgccacaggcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaaggagctgtttcccattcagatggagggtgtcaagctcacagtcaacaaagggttgagtaaccattttcaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcaccctggggaacccagacgtcctcgtgggttcaggaatcctcgtagcccactacctccagagcatcacgccttgcctggccctgggtggagagctggtctaccaccggcggcctggagaggagggcactgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggtaaaggtctcggttcccctacgcgggaaacaggcaggaggtgactcaactctgagtggatgtgtgggccaccacaggtgctggaggacagtgtgctgccaccctgtgggcctccacattaccggggaacacttgttaaaaggtaggtggggccgggtgcggtggctcgcgcctgtagtcccagcactttgggaggccaaggcgggccgaggtaaggagattgagaccatcctggctaacacggtgaaactccgtctctactaaaaatacaaaaacaaaattagccgggtgtggttgcgggtgcctgtggtcccagctactgaggctgaggcgggaaaatggtatgagcccgggaggcggagcttgcggtgagccgagatcgtgccaccgcactccagcctgggcgacagagcaagactccatctcaaaaaaaaaaaagtaggtggacaaccctctactatgttttatgcttggaaaaaaaaagtaggtagagcggccaggcgtggtgactcgcgcctgtaatcccagcattttgggaggccaagccaggtagaatacttggggccaggagttggagaccagcctggccaacgtggtgaaatcccctctctactaaaagtacaaaaattggccaggtgtggtggcgtgctgcaactgtggtccccgctacttaggaggctgaggcacaagaatcacttgaacctgggaggcggaggttgcagggagttgagactgcaccactgcactccagcctgggtgacagagtgagactccatctccaaaaaaaataaaatgaaataaataaataaatgttaaaaaaatctggtggagcatctgatgggtgtttgggccaagctggagctttgtccatcccctcttatttttctgcacttgactctcttatttttctgagactggtctccctctgtcgcccaggctggagtgcagcagtccaactgcggctcactgcggcctccacctcccgggctcaagcagccttcccgcctcggcctcctgagtagctgggaccacaggtgtatgccaccaggcccagctaatttttttgatagttttgggagacatgggggtttcaccgtgttgcccaggctggtctcgaactcctggactcaagccttggcctcccaaagtgctgggattataggtgtgagccaccacacccagccagggtagaaggcactttggaagcctcgagcctgccccattcatcttacgttagtggaaactgaggcttccagaggtttcaaggtcacaactaaatccagaacctcatctcaggcacactggtcgtagtcccaatgtccagtcttaagtcttcttggatatctgtggctcacagattttgggtgtttgagcctcctgctgagcactgctggggccacagcggtgaccagccctgtcttcacgggactcagtgagaggaacagattcatccgcagagtgggcaggactaggttgggggaacccaggggtctagagggcttttcagagggcaggggtcactgagcggagagcagaggaggagtgagccatttgctccagcgtgaagttgttggtgtgatggggtttcagggtggcaggagcagtgtggttaaaggtctggaagctgtcggcatgtggctggtatccaaggtggccaggaactctgcatggatatggtgggaagctggcacgcctctcacctcagctcttccctgcaggctctgtggatagcaactggatcgtgggtgccacgctggagaagaagctcccacccctgcccctgacactggcccttggggccttcctgaatcaccgcaagaacaggtttcagtgtggctttggcctcaccatcggctgagccctcctggcccccgccttccacgcccttccgattccacctccacctccacctccccctgccacagaggggagacctgagcccccctcccttccctccccccttgggggtcggggggggacattggaaaggagggaccccgccaccccagcagctgaggaggggattctggaactgaatggcgcttcgggattctgagtagcaggggcagcatgcccagtgggcctggggtcccgggagggattccggaattgaggggcacgcaggattctgagcaccaggggcagaggcggccagacaacctcagggaggagtgtcctggcgtccccatcctccaaagggcctgggcccgccccgagggggcagcgagaggagcttccccatccccggtcagtccaccctgccccgtccactttcccatctcctcggtataaatcatgtttataagttatggaagaaccgggacattttacagaaaaaaaacaaaaaacaacaaaaaatatacgtgggaaaaaaaaaaaaaaa

SEQ ID NO: 153 - DNA, 60 bp, Homo sapiens
catctcctcggtataaatcatgtttataagttatggaagaaccgggacattttacagaaa

SEQ ID NO: 154 - DNA, 3018 bp, Homo sapiens
tttctgttttggtaccagtaccatgctgttttggttactgtagccttgtagtacagtttgaagtcaggtagtgtgctcctcttaacctcagcatacctgacagaagaaagcttaggcccctgtcgaggtggcagttctctgaggtaaatgctctctgtgcaaagacctccatttctatttaaaaagatgtttgtatgttgtccaaaaatagacacagttgtgccaaatgtgttccacaaactagtgaaccacttctattccaaagcatctctggactttcacagcttgcaaaaggatattgataagctttttcaaaaccaggatcttgatgatcatgatgattgtttcagtgatacctaggaaacattcccgccttttacaaggatgcctctctcttaaataggtgctcttgccaccttatctccccaggaaaattcacagggcaggttaagaaaccttcaactagctatttcctcaattgtaaacatttctactcacaggtctcagagcacttcaaactcagtgtgtccaaaacagagctaccatctgctccagatctgctttatttctggtattcttagctccttgaatggcaccatcatataataaattggacaagccagaacctggaagtcaatttgtcctttccctctctgtcatgttccatatctaacttaacatcaagctctgtccattttacttcctgacttcctctgtaacccatttcttcccgtgtttaccatcacctggtctcagctacccctgtctccctcctgactggcctcccacttccactcttgcccctccactcaattcttctctgttctgcagcccaagtgaccctctcaaaatgtaaatctgatcatgtcactctcctccttagtgctccctagtgactctccagagcttttggaatgaaaagcaaaattcctgtcatggtccacaaagccctgcctagtctggctcctgccaacctatttccccacaatccagccacgttggctctctcctcctgtgtttcctgccaccacgtggcctttgcacttgcggtttcctcttactggaatttcctcccgccctccctgcttgcttcagtctggttaactcctacgtatttatcctctatatctctgcttgcccgactcctttttggaggagcttttcctgatcctctaggtcaaggggagctcccaacatctccccattagtgccatgctcctttccttccttgcatttgtcagttttaatttccactcctatgagtgatcactgggttaatgctttctcccgccacccacccgtctacaatctccatgaggttagaatctgtttctcatttgttcatccttgtgtccccagtgcccagcctatttcctgaacatagtagaggttcaaaacatatttggaaaatacatgaatactcacattttgcttttcagacttttcctcctagaatatcattcacctgattcgggtgtggggtgtggtctctgtcaaagatgcactaatgattgttccttgcccgtacaattctcacagtgacctccacgcttacttagccttgatttccttgacctgttttgatggttctttctcaggagagcctgcaggaacttctgaggatggggctttggggatgtgaggacaatggaaaacagcttgtcagggagatactgatgcactgccagccttgctgagacagggcaggaggaaccgcctctaaatctcaggatagttcacctggaatgtgggaagacattctcagaaagggttcttcccggggccctcctcttcatcctttcttgcctccctcccttcctccccatacccctcaggcttttatagatgcatatttacagaggacagggctacctttttttgcatattgattcttttgaaagggcagacctttagaactaaagaaatgaccacaccgctgttagctttctgcaaaacagcatagcactttcccggtgtgtgtttattacctaccccatgagctaaacatgaggcaaagtagtaattggctgggtctctggtgagtccatttccctgcgttgccccgaggtgtatgcaggctttacacagctaccttggcaactgacttccccaatgtttgctgtgtgtccaaggacgagcagggatctatgacactgggtgtttctagcaaatttccctctcaaattggcacattctctgtgagctttggagacttcacagtgtggctcacagtttgggaacaatttgcatcatcatctgactggtaagttctagttctgtggtaactcaagtgtttcaaatagcttaatacgcaatagggcacggaggttcgttctgcttctgttggaatcaaacacacatttccacaatgttcccgttatacaggatcatcccgaaacacatcccccagaacactatgttgtcactactctaccttttgatatacactttattattattcctatgtgcagataggttacttaagtttttctgttctagattagtttgtctattcaaatacatgtttctcacacacttctacagtgtttttctttttgttgttattcttaaagtgttctatgaaaacttccatgttgtatcaaggctgggtggtagctttgtaactagtttcccaccttagaatgactgtctgctttgtccaggactgcaagggggacttagaatatgggatttttcagtgctaaaactagaaaagtctgagacaaatcaggacaaagtggtcaccctgctaccatttctagccttgataaaggagcaggtagacccaaccaaggataatttttgttttctatgtagataccagtttagtggttggtaggaattcccccaaatcaacaccttgctaagctcatctctctctctctcttttaatataacagcttattgagataaaactcacataccatacaattaatgcacccatttaaattgcgaaattcagtagtttttagtatactttcagagttgtgcaaccttcatcacaatcaattttacaac

SEQ ID NO: 155 - DNA, 60 bp, Homo sapiens
ttctttcattcttttattaactgatttttctcttgagaaatcaccactgggtcaggtgtg

SEQ ID NO: 156 - DNA, 4565 bp, Homo sapiens
gctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacgtgaggagagaggggtgcagaggggctaccaggaagtgcagttaggagggcaggccagggaggatcccacagtggcccaggggtttgagatttgagcagcaaataagagaaaatgtgtggatctgaaatgtagaaagacggaggattgaacctcaaggggaacaaggtggctgacgtgagtggaacaggagtaaagaaggggaggtgaggcttgaaccgcgaggtgccatgtggggagcttatgcagaggctggggcatctcaggatgcatacccaagatgttcttgccttgttatcccagattttgatgttccagatctgatgtgggcccaggcatgggaatatttggaatcccaggggattctgacacatgctttttctcacccttaaactcttgcattgacaatggcttgaagtttgtgaaagtaaacttgaagatctccacagtacagaacagtgtgtctcaagggtggtttctgaaccacctttctcagaattgcctggaggaggtgcttgttaaagatgcaagccccttagtaccactccagatctgttgaaagaaagtatctggggatacagcctaggaaatctgcattttaacataattccttggatttttatttaagattgtgtttgaaaaatgtcaagacagaggcaagcaagaggatcacctaggagagtaaattagtaaaagatggcagtattagcaatctcattagtttgactacattcattccaaatttaagagtgagtcctaagttaggcttgtttccttgaactatgtgaggagaaaaagctttaactagcaaaagaacgtattaaacaagatttggagaaaaattccttttccaccttaaaaaaacccaatgtacaactctggattactcttagcttccttatttcaaatactttccagtttatgtacttgaaataaatacaacaacttctagaacagcttgcagttcagatctggcttttactaattgtaatcaaacataattctggaggaggaaagaaagaaaggggcaatgaaggaatgggagagaagaaagagtaatgcaggaatacattctaacggttccccttcaaggggcagcatggcagagggggctggggtggaaagtgggttgcaaaatctacgaagagttgcgatagggaagaaaccaggttgaggaagcagccagaatgtcaccctccttcctaaacatgtttttttctcctatgcagggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggagtaagtgtatggcagatggatggaattagggtcaaagcagagaaaatgagatgtggatcgatacatggtacatggtagacagcgaagtgctgaaaatggggactgagtctggaggaacttacggggggcttaggaccagaatggggaaatgggataaagaaatggaaatatttaggttggtgcaaaagtaattgcagtttttgccattactttcagtggcaaaaaccgcaattacttttgcaccagtttaatatttagtctgtgctattgctgctctggtggtgtggttgatgttgctgcgtctatgtttgagggtgagaggggagcgtgcttgctttgaaatgaggatgtaaatttggcaatcatattttcagaaccccaaattgtaatacactattctagcctccttagatttcaactattctggtgccagaagcagatgggagctgaaggaatgatgaaggttgaagaaggggggcttttcttggtgtggggcagtactgcatttggcctgctctaccaagcatacgggagtagtaaagccacggctggcagaccatttggcatgcatgctcaggggccagtggataaagaattacttacagttcaaacactgtttgaactcagtgtcgggagtagttaaaggtatcgtgagaagttgcacacagctttggggactcttggaaaagaaagaggaagaaatgaggaagaggaagggtgtctacaaagggccagagaacaggatctcagatcagctgctgtaaccaggtttccccttgtgggaagtgttgtttcttgctgggcagttgggaagggaatggagaacagagaagagagtggaaatcacatgctcacttgaactttcctggggaacgtctcctcacagcgtgcacaagagcctccctttagaaatggagtgttcattttatcatgggaaaagaatctgagtgggacatgattcagaacaggaccggcccaaggaagtgcaggggctgtggagtgggatggagacaagctctgaaaggacacatgggagatctagatgtaggaggtacacaagtagtaggataactcacaggatggatccactggaggttaagacatgtggtaagacagtgtaataggaagctgctcagttggagaaagtaaggaagcaaacattgttaccgtgggggcaatggagaggacagtgaggagccctttatcctgataagggtggctttggggtaaaggaaggaaagaggatgccttgagaggccccactgtattagagaggacctggaagccaggatgctaattctggggagatgggttccccaggcttactctaggagtagaggtccatgggacgagggtttgatttgagaaagatcattttcttgggagtgggtggtgtgagctagacccttggagctgggataaaggaccttttaacccactgagaggtggctgcaataaatggaattgccctgggggtgagcaacagaaactgggtcaagtaagtttctattttttgcagcacctgggctgtcccccatgcagaccctgaaggtttctgtgtctgcagtgactctgggcctgggcctcatcatcttctctcttggtgtgatcagctggcggagagctggccactctagtgagtgactcgctgaactcccatccccactcttggtcccactctctgcttactttctgtttgtgattaactctctccttcctactgcatttgctatgaatactgctagatattttcatccacaaagactggtataatcaagtatcttcctctcttaggttacactcctcttcctgggtccaattattcagaaggtaacatctctgttggtctgtttccctacttgccctttggtaggggtgcgggttagaggggtcagtgttgggttcaactaatcttgattattatatgggtgagcttccatgaggatctaggcaagggcatgatttaagctgccattgctaggattaagagcaggaaggagcatcctcctcttctaccaagtgggatgtctgtggagaggaggctgaaggtgcttcctttgtattagttgttggtgccctggagttttcagtatcactgtattaaggcatgggatggttacagtgacaaacgatgggggcaagttgggttgaagcctcattatctcccttttatttattctgtaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatat

SEQ ID NO: 157 - DNA, 60 bp, Homo sapiens
ggactatgctgtaaccaaattattgtccaaggctatatttctgggatgaatataatctga

SEQ ID NO: 158 - DNA, 7080 bp, Homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccggggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtc

SEQ ID NO: 159 - DNA, 60 bp, Homo sapiens
catatgtttcacagtacaggatctgtacataaaagtttctttcctaaaccattcaccaag

SEQ ID NO: 160 - DNA, 2224 bp, Homo sapiens
gccgcgtttgtactgtgtcttaccatgcctgaaccggcaaaatccgctccggcccctaaaaagggctccaagaaagccgtcaccaaagcccagaagaaagacggcaagaagcgcaagcgcagccgcaaagagagctactccatctacgtgtacaaggtgctgaagcaggtccaccccgacaccggcatctcgtccaaggccatgggcatcatgaactccttcgtcaacgacatcttcgagcgcatcgcgggagaggcttcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctccaagtgagtccctgccgggacctggcgctcgctcgctcgagtcgccggctgcttgactccaaaggctcttttcagagccacccacctaatcactagaaaagagcttgttcacttattcccttagtttcttttcataaagtaagttattttagtgtgaaggtcatgggaaatggcatacgtagctttttaactatttggaactcgaggtccccagtgcgtcattggatttgcttttgaatctagagcgtgtctttactcattgtgctgcttagccttcccaggagtcggttctcaattaggctgttgggaatccgcctctttacccgcccccactcccgccccacacgcgccctggtggctccttgggtctgtttcattctaaaacgaagtggctgagttcggctgtcatttaagagaactccaggacacaattcagcccgggttccgcaaacactgcgtgacagctctgtatgactgacgcttggcagcagcttttgtgtccggtcaccagttctgccgtgcgatggggcctcctgtggataccagccgttctgtgtattttggacgaaggccgcgcagccgggtcccagccttgtcctgattgggcgacaagaatattcaaaattctgcgcctttttctaatttgtagatttcagtttccgtcgttcactttgagactttgaaattcctatttctcattttgttgataatttctgcatttaatggtctgtgctttaaatggtaacgctacggccccaggtcactgcgaggcacttaccatgtagatacgggctcaaaagtcacctctcagagacctacgtcatccactcaggaattcgcgcctctcatacttgcctgtctcattttatcttccttctagcagctgtctgaaattggttcgtctgttttcttgtttatggtattctcaagcccttgacagaccggctagtgtggttttcccgtgcatcttcagcctggcacattatggacacttaaatactacgtattgatctaatattgttgggttaatttttccatcccacccttttcttaatcgcttccgtggatggatgaagggtgctgttcatttccattagatgtatgtgaaggcacagtgaaaatggaaatgttcttggagctacttcctcaaaatgtatccttagtcacctcagtgcaacagctgggagggggccgtgttaagattttttttgctacaaagaggaggtggcaatggtagatccacccttatgcttctcagtttagcataacctcttatggattttcatcaaattcagcgtgttggtcactggaaagagccttttccttctccttttcttactctcccctcatggtgttcccctcttaaaggagaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctcctacatgtgtgttttcaaatgtgtatagatgctattgttattaataaagttaccaattaatttaaaaaaaaaaaaaaaaaaaaa

SEQ ID NO: 161 - DNA, 60 bp, Homo sapiens
cagactgaatagatcttaactgtctcctacatgtgtgttttcaaatgtgtatagatgcta

SEQ ID NO: 162 - DNA, 4700 bp, Homo sapiens
ggaaacaataccgcaccgtgcggagtggcctcctcccgccccggcctgtgcccgccgccgccgccgcccctgcctgcgcctcccgcctcctgccgcagcccgctgggctttttccctccttcccaatcgagtctgggcgtccagcccccgagtgctcgtcacgctggaccctggcgcggagccctggcatcacgactcggaggccgagactctctcctggagtcacccaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggcaatgctggctatcggcttcctctccctgccagtttcccagcagtcttgcccattggggagcagccccccgaagggcagtggcaacatcaagcagaggtacagattgcccgaaagcttcagtgcattgcagaccagttccaccggcttcatgtgcagcaacaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggactgacactgtgtcttgtgaaattgtttttttgttgttattttgtgttttaattttttttaatttctctctgagtgtacatacaacatactcaagcgggaccttctttctctgtcaggcccttgacctggaatgggggcctttgtcaaacactgttgaaggagaggctgatgtgtctgtgatggtgagaattcccaagggctctgacaagtagattcttcgactgaggaatctaccagttgtcgaagatgatccgttagtgatgttctctgggaagtggactgtggtttttccagaggaactcagttaagaaatcgagagtggattagactcccagttccaccaaacctatgagccttccactgtggatgggggccgtgatcctgatggtcacattgctttaacccagcagggcttcggccaggggctttccacttgaggatagcagcttcactaggctggccggccagctccacatctgactgggttcttacttctcagccagtacctgccccatgggctcaaggattcctggccagctcctgccacctccagcagacctcagggagggttgggtttctctaaggacccctcaaacatgtcgcaaaatgaaccaaacttctggctaggcctcaaaactgacttggtcccacttggaggccccaggattggtcctgaggtacagagccactgccaccactggcggcctgggaccagctgggtgtcagccacggatgagccgaatagccagtcagcatgttgctgctggcagcctgtgcctttgtcagctcttctttcaaaagaccccaccgacagaccgcattccacccccaacatcggcactgagggacatcgggggcaagtttgcagtggggccggaaaatatggtggccaccctaccatgagagtcagccgtaggggaccccagaccccttggtttccttggaaacaacatacctcttcccccttatccccagtcctttttcatacctagtgggatacagaagaagccaggacagtggctttgccagctaagtgacttttagagtaacagataacgattagagtggggaaccgtcaaagctgggtacacatttcctatcttcctccagcttccagctaggccagaagggcatgctctggaacccagcaggatcacagctgcctgtgcacgtcttcccttctctccctgctgcggcacttatggagaggatctaaagcagccggtgtggcagctccgatagcaggcacagggaatctgttaaccagacgctagaaactaaattataacttttgcatatgtgagaaaagacaacattggtgctaacagtgaagtaaggcccaaaggaaagacggcttccctggacaaagaagacctcagggctacccaaggaaataggaggagtctagagtagactcacaaatctgaacaagcccaagtcttccagttctgaggagaggaggtcttcagtactattgaaggagacattgatcttctggatgtacagttgtgcaggttgttcactgcacaagggcacctgcagctaatggaggctggaattcagcttgtgttctgctcactaagctgtgtgcgtgccctggtgtggggctacttctcccaagaagaaggggtgcctttcctaatttgcaaaggtgccatatgggctcacagcaccctggaggagaagggcctcaaactgtgcatgtaagcctttgttttgttctgctcagatattctggatattacctcttcttggtcagaattctattctcagggtgtgtaccatgatttgtctgctaagaagacgggttcctgctttgcagagaaggagccggggaccagcttgaagactggctctgggacacactgaccattgtgaaattcagccttccctgtgggtctccataccattttatgatgtgtatgggacatacgttgttctcccctctctggatcaaggtggtgacaggcagcctgctgccgtatgcttcagtggcacacaccaaaaaaccgggattatttacagcagccactattcaccccttttggcagactctccacctgagttcagtgagagagaaaatgatttagatcttggtgctggggcaaggccatcagcttcagagaccttgccaggcccaggctgggtgccctgtggcctgagaactgagcccagactttgacaaacccacctcaacatcaagcctggggcaggtggaaggtggtctgactgcactgtctccatcttatgcaaagccaggaactcactcactgtcttaagtgagccagggcaaaatttacacccctcacgtttccctctcccttcttccccaccaacaaaacccaggaggtagctggcagagtagctgtcaggaaggagaaaggttctttctggctggttgtttttaattggcttagtgatctaaactggccccttcctcctctgcctggtgagttggcctaaacattcctcaagtctagcctcaggagacctgcccctcccccccgacctccaccccctcagactccatcccccacccccaggagcctggctgtctctagcgaggggtggagaatcagatttagagggagggagagtctgacctggatcctgacctgtaaccagctgaagacggtggaggctttgtggcttgctgagggtgggggttgggagagggactggaaaccttcctcctcgggaaagaaatgcctgggaggaagggaagcctgatattcagggtcaaaacagcccttctaattcacaaccccaaagcaggggtttctagaagttggtcaacagatctggtgagggaagtccccaggccagacgctggactcctgcaatgagggtggaggactcagcctggcctctgcctggcctgtttcaaagtctgggccactggcagccttctcttgctcaatccgaggtggaaaaagatcacctcccagtgacctccctcagcccccaggggagtaggtctgtgtccaaagctatgtggcaggcttgtttgaaggacccagaggggcccagctgacctgtctcactgctcctggcagcccagccccatcggcaggtggcccctgcctgggggttattcgggatggttcagccagggcctcccaggaagagtgctgtggagccacggtgactgtcctggacagcaaggagcatgctaccccagtgagcacttctttttgagggacttgatggggaggtggggtaggcagaagggacgtggcagaagcgggaagactttggtcaccatggctctgcaggccttctgcaaatcagtgctggcctgggctggaaacagctctgtgtgtgaaggtgaggactcttggaagcaggccatcctggccagacaccctagcaggaaggggctcacctgtcacccttaggcagcctgagggctggtggggacttttgagtcttgaggggatagcggaaaaagctgagctcataggtgcccagccagcctcccagctaaaggtgctcagagccccactgccccctctctctgtgcaggtggccagtgcccctccctgctctgggagcattgctagccttctaccccatccctggatccacaggggctatcgaggagacccagtgagaatgtagcattttgttcatccccagggtagctgccctggggtctgggcactctgcctctgggagagaggaagaagaaaggggccccattttttaaaaaactgtacagagcctttggctttatgtgtttatgttcttcacatgcatatgtgtgtatgtgtgtatatctttccccccatcaattggtacaatttttaataaaatcatttaaagcaaaaaaaaaaaaaaaa

SEQ ID NO: 163 - DNA, 60 bp, Homo sapiens
ggctttatgtgtttatgttcttcacatgcatatgtgtgtatgtgtgtatatctttccccc

SEQ ID NO: 164 - DNA, 4006 bp, Homo sapiens
gccctttgatttaacctgactaatattgacagatgctttacccagatcattcttagagcttgatttctgaaacatggggagcttttgcagcaatttttattctgtatcgatggggcatcatccttgagataatagtaagtaatcttggtcctgaaatcattacaatttcatattgaattgctttatgttacttcctctattatgccaggcttctgttccttggtttttttttttttcttttctgtttggttcttctaagttaaattccttctggcggtataaaatagatgttaagtttatgtgctctggagctggagtgggttcaaattccaggtcagtcactcactagccatggagcctcggcaattatttctgtgattctgtttccccatctggaaataatgatgataataccacttatctcatagcattgcagtgagaataagatgagtcaatacttgtaaggtatgtagcacaatgtctaacatatagtaagcactatgtaagtatgggctattttatataatatttccagggcatatgagaataggtgagcaagatattgcttcttcatttgtcactagtagttttcaacatcactatgattatcaaattcccagaaaaaatgtaataattcattgggcatttgttagctttgatgaatacttttcagaaggatttcttagttcttttaatgtgtgatgttgaaaataggttgtgattacagtcattcttgtctttgggtagtgaacattaagtcaagttgaaacattattcaggctgataagctaagtgcagcagatattatagccattgataaattaatatttactgagtgagcattcagaggtagaagttgctaatttctatgttagatactatcttatgtgtctatattgtccttgtcccttttgaaatattcttttgagtgacatattatggccatttgataccattcaagtgaaatatttctgtatcttttgggttttgacagttgaaatattgattatatgtagtttagttaactatatattgttatgcatagttataggtcatacatatgtatatatttaattcctatttggagttttaatagtgtcctagaatgttctcctcattgtaatcatatttaaaaaccattttatgcccaaaataaaaaaagaaaaccccacgaaaccccctaaagccttaaaataaactttctttgatttcttctcttttggtttgtgtttctgtttttccagaaaatgttcctgagaaagatcttcatggaagactttttatcaaccgtatttttcatatcagtgctgacagaatgtttgaattgctctttaccagttcacgctttatgcagaaatttgccagttctagaaatataatagatgtagtatctaccccttggactgcagaacttggaggtgatcagctgagaacgatgacctacactatagtccttaatagtccacttactggaaaatgcactgctgccactgaaaagcagacactgtataaagaaagtcgggaagcacgattttatttggtagattcagaagtactgacacatgatgtcccctaccatgattacttctataccgtgaacagatactgtatcatccgatcttcaaaacagaaatgcaggctaagagtttccacagatttgaaatacagaaaacagccatggggccttgtcaaatctttaattgaaaagaattcctggagttctttggaggactatttcaaacagcttgaatcagatttgttaattgaagaatctgtattaaatcaggccattgaagaccctggaaaacttactggcctacgaaggagaaggcgaaccttcaaccgaacagcagaaacagttcctaaactttcctctcagcattcctctggagatgtgggcttaggtgccaaaggggatattacaggaaagaaaaaggaaatggaaaactataacgtcactcttattgtggtaatgagtatttttgtgttgttattagttttgttgaatgtgacactgtttctgaagctgtcaaagatagaacatgctgctcagtccttttaccgtctccgcctccaagaagagaaatctttaaatttagcctctgatatggtgtcaagagcagaaactattcagaagaataaagatcaggcccatcgtttaaagggagtgctccgagactccatagtgatgcttgaacagctgaagagctcactcattatgcttcagaaaacgtttgatctactaaataagaataagactggcatggctgttgaaagctagtgatctgaaggactaaaaccgcagagatacttggaacttaaagaaaatacctggaagaaaaccagacgaatgaaggattttggcatagaacatttctatgttttttcattattgagatttctaatatgaacatttctttcagtaacatttatttgataattagtttctgctggccttaataatccatcctttcacttcttatagatatttttaagctgtgaatttcttcagtgaaccatgaaatatattatagaactgaatttctctgatacaaaaagaaaatgacacaccctgaattgagtggtatggtctcatttctacagtgaagtctgatgctttgttagcacagaatccgtacatgtccaataggtcgcttttgtaactgagataagaccaagaggataaacaggacaatataagaagaaacctctatgtcattactgattttaaaggttctgttttcaggcatataacatttccaggtttgtgtactgtaaagattataatgtcttcatttatttagcatgcaaatttaatagtcaaactttttgaatctgcatgttgatgatgattatcagaaagggtcttctgccatgctgtatctttatgaaagaaatagttgttttttcttaaggtaactatcagaggtgggattatcttgcctcctcacttagaataccaacagtcaaaaggaagaaccatcctctgagttttaaaaaccagaaggttatgttaaaatctgggcatttagtgacagatcaaatgcatacttgaactaagattggcttcagcttagcagtctttcatggtggaagtgacacatctggttgaaaataatttgtgtattttcagtaaccatgtatggcttccttctttatgtatgtgtgtgacttgttttgattggtaagttataagccagacatagattttagctctttaataaaaacttcaggggcacgtatgtcccagtacaagtgtactgactatcaagttttaactcagatgcaagctttggctctttcataaaaagtttttatgcatatgtgtctccatacaagtggctcattaaaataagaactttgtaaactgacttaaaatcagatattttttcaagagttagggaaagttgaagtgttttactgttttgtctcttgagccctttctctggggaaaaaatacatatccatctatctatctatatataaactgtgtatacattcttactgtttgaacaactattgcctttaattaaatgtttcatttttctccagagtccccaaagccacatggcattattatagtcatttttgagatgcctgtagagaatgaaagtattgactccgttagagggaaaatgggtttctctgggtgaattccaacgaagcatacctaggggtaacagtgaacctacctgggtttgttttgttttggtaaggatttatgtagtgtctggctgtaagcaagaatgagtggattataaacttgaagatttctctgttaaagtcacaaaaatgatcgacaaacaatatttttgtgatgtttatttaaacgttgtattttataacatacttcaaggaagagtatcgaagtaagttgctttataaattaagactaaattcgtatggatgcagaattcaattaataaaatttgagcctgttacgtaaattgaatattaataaaattgaaaatttaaaaaaaaaaaaaaaaaaaaaaaaaaaaaaaaa

SEQ ID NO: 165 - DNA, 60 bp, Homo sapiens
gtaaaatgagactactgcttgttgattaggcacattaagatcttagagtctttttggaag

SEQ ID NO: 166 - DNA, 3390 bp, Homo sapiens
agaaggggaaacaggaatcgattaggaataaaggattataatccactttccttctgaggaaaagctgggaaccttctcattttgccttatgaaaactaagctgaatcgactgctgccaaacatctattaggcaaaattggcctcttgcccatgatttgactttccagcacagccagttctttttctcctctgcagctgattggctctggagtgtggccagaagcctctctcctgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctcagcctccctagtagctgggattacaggtgcccaccaccatgcccagctaatttgtatttttagttgagacagggtttcactacgttggccaggctggtcttgaactcctgatctcaggcaatccacccacctcagcctcccaaagtgctgggatgacaggcgtgagcaaccgcacccagcttaaggtttttttgttttgttttgagacggagttttcgctcttgttgcccaggctggagtgcaatgctgtgatctcagcttaccacaacctccacctcccgggttcaagtgattcacctgcctcagcctcctgagtagctggtattacaggcatgcgtcaccacgccggctaattttgtacttttagtagagatggtgtttccccacgttggtcagtctggtctcaaattcctgacctcaggtgatctgcctgcctcggcctcccaaagtgctgtgattacagacgtcagccaccatgcctggcctgaaaccttttttaggtaaagttgaattccatccttaaaagtttctgttatatcctatttagccattttctattgtctcccaaagaattcacatcaaaaaaacagctttgaactcccccttcaaaggaaacagtcgactttcataattagcatctaccattatccccaaatcttattttattcattgacttgaaattttttccaattgcttttttttttttttttttaaggttaagagcagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgcctgtaatcctagcactttgggaggccgaggcgggtggatcacgaggtaggagttaaagaccagcctggccaacatggcaaaaccctactaaagatacaaaaaaaaaaaaaaattagccaggcgtggtggtgggtgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaatatggttta

SEQ ID NO: 167 - DNA, 60 bp, Homo sapiens
actatggaagctgtgaaaatcatcacaagtgcctctgaaagcgagtgttaggttggttag

SEQ ID NO: 168 - DNA, 3187 bp, Homo sapiens
atgtccatttgttccagggtatagtttaaatccattgtttctttgttgactttctgtcttgatgacctgtctagagctgtcagtggagtattgaagtttcccactgttattgtgttgctgtgtatctcatttcttaggtctagtagtaattgttttataaatttgggagctccagtgttaggtgcatatatttttaggactgtgatattttcctgttggacaaagcgttttatcattacataatgtccccctttgtctttttaaactgctgttgctgtaaagtttgttttaatgatataagaatagctacttttgcttgctgttggtgtccatttgcatggaatgtattttcccacccctttaccttaagtttatgtgagtccttatgtgttaggtgagtttcttgaaagcagcaactagtaggttggtgaattatctattctgccattctgtatcttttaaatggagcatttaggccacattcaatgttagtattgggatgtaaggtactattccattcattgtgctatttgttgcctgtatacctttttttaattgtatttttgttttataggtcctgtgagatttatgcttttagaggttttgttttatgtgtttccaggatttgtttcaagatttagccctccttttggccgttcttgtagtgctggcttgatagtggcaaattctctcggtgttagtttatctgaagaagactgtatctttctttcatttatgaagcttaatttcactggatacaaaatttttggctgatagttgttttgtttaaggaggcttaacatagggccccaatcccttctagcttgtagaatttctgctgagaaatctgttgttaatctgatagatttttataggttacctggtgcttttgcctcacagctcttaagattctttcctttgtcttaacttttgttttttttctttgagatggagtctcgctctttgcccatactggagtgcagtggcgtaatcttggctcagtgcaacctttacctcctgggttcaagtgattctcctgcctcagcctcctgaatagctgggactaaaggcatgtgccaccacgcccagctaatttttgtatttttagtatagatggagttctgctatgttggccaagctagtcttgaactcctggcctcaagtgatctgcccaccttggcctcccaaagtgctgggattacagatgtgagccaccgcgccttgcctactttgtcttaactttagatagcctgatgacagtgtgcctagatggtgatctttttgtgatgaatctcccaggtgttctttgtgcttcttatatttggatgtctaggtctctagcaaggccagtgaagtttccttgattattcccccaaatatgttttccaaacttttagatttctcttctttcccaggaatgccaattattcttaggtttggtcatttaacatatcttcaaacttcttggaggctttgttcattttttcttattcttttttctgtgtctttgttagactgggttaattcaaaaaccttgtctttgagctctgaagttctttcttctgccatgttcagttctattgctgagactttcctgagcattttgcatttctctaagtgcatttatttcctgaagttttaattgttttttatttatgctctcaatttcactgaagatttcccccctcatttcttatatctttttttggtttccttaaattggactttacctttctctggtgcctccttgattagcttattaactgaccttctggattctttttcaggtaaatcaaggattttttcttggtttggatttattgctggtaagctagtgtgatttttgggggatattagccttgttttgtcgtattacctgaattgtttttctggttctttctcatttgggtaggctatgttagaaggaaggtctagggttcaaggctgctgttcagattcttttgtcccatggggtgttctcttgatgtagtactctctgtgttttcctagggatgtggtttcctgagggctaagttgtagtgattgttatctctcttctggatctagccatctggtaggtctacctgctccaggctggtactgggggaaggagggggtgtctgcacagagtcctgtgatgtgaactgtctgcaggtctctcagccatggataccagctcctgttccagtggaggtggcaagggagtgaagtggactctgcaagggtccttagttgtaattttgtttattgcactatttttgtgctagttggcctcctgccaggaggttgtgcttttaagagagcatcggctgtagtagtatagggaggatcaggtggtaggtggggccctagaactcccaagagtatatgccctttgtcttcagctaccagggtgggcagggaaggaccatcaggtggagacagggctaggcgtatctgagctcagactctccttgggtgggtcttgctgtggctgctgtgggggatggaggtgtggttcccacatcaatggagctgtgttcccaggaagactatggctgcctctgctgtgtcatgcagttcctctggcaaccctccccaaggatccttcctaggcaaggcagaaatggcttccttgtggatccagagagcccacagggcttttcccactgcttcctctgccccagtatttcactcggctctctaaactgactcagctccaggaaatattgaaaatggacatgtgaagctcattgttatacatttaaaaaataacagagaacacctacctcttattggaaaagttggcctctcgtggaaaactgatatttttgatggctgtataaagagttgttccatgatggacgtaactcttttggatgaacatgggaaacccttttggtgtttcagttccccggtgtgcctgagatcgcctgccacaccctctgacagctctagcttcttgggacagacatacaacgtggactacgttgatgcggaaggaagagtgcacgtggagctggtgtggatcagagagaccgaagaataccttattgtcaacctggtcctttatcttagtatcgcaaaaatcaaccattggtttgggactgaatattagcagtaggtggcaaattattgttgttatttagttgtttatttttgactggctttgttcttggtgttgaaaattaaaataaagcaaatctgc

SEQ ID NO: 169 - DNA, 60 bp, Homo sapiens
ccattggtttgggactgaatattagcagtaggtggcaaattattgttgttatttagttgt

SEQ ID NO: 170 - DNA, 5222 bp, Homo sapiens
cttttccaagacttttctgggttagtttgctttccagcccactgatttccttcttattggacaggtcactcttttgcatcccaagcctggcttaggcaagtccctgaggttagtaaacaccttcagtgcccctcagccgagtcccttttgaccatggaataccatcagcctgaggatccagcccctggtaaggccgggactgcagaagcagtcatccctgaaaaccatgaggttctggcaggcccagatgagcaccctcaggacacagatgcaagagatgctgatggggaggctagagaacgggagccagcagaccaagctttgctgcctagccagtgtggggacaaccttgagtcccctctgcctgaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaaagcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccacccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggcacggtggctcactcctgtaatctcagcaatttgagaggccaaggtgggcggatcacctgaggttaggagttcgagaccagcctgcccaaaaaggtgaaaccccgtctctactaaaaatacaagaaattagctgggactacaggcatgcgccactgcgcccagctagtttttgtatttttagtagagacggtttcgccactttggtcaggctagtcttgaattcctgacctcaagtaatccgcctgccttggcctcccgaagtgctggaattacaggcgtgagccactgcgcccagctacctgtcatttctaatatagcctgcagggggaaccaaagcctgactttttgtttttgtttctgtttttgtttttgttttctatgggaaatagtgctctcctgggaggtgggtttccaaatctctgcttggacacatgaatttgagggttgtgctctccactaacccaagaattcccatgctggggagggtagcttggccctccgcttgcttcccagttcatacagatggtcctttgctccctctatttctcaccttgttctaatgcctgtttctcaattattttgcctgaagtttcctggagaatgagggtgaggggagacctggagtgggagacctgggtgtggattactgtagcactaaggcaaaacaggattcctgcggaatagccaagtgcacatcaaaggcacctccaactccagtgcctcttcccggtccatgtcctgctccacccaaccttcaatcagggaacacaaacaacagcgaagtttgccaaaagaattcgagtatcagtgagatgttctggccagggtacaggagggatgagtgaggcagaaactatcaaagaaaactcatttccccacacccaagaaggagctggatgacccaggtacagatataattttgagatgggaaaattaagggattttaaagaaacagttccagcctcaacaagaagctagagaatgtggtgctcagtgaggggttatcctacttggaggcccagctggtctcccaggttcagccaaacacggaaatctcagatcctcggatgtcatgtggggtggggcagggaagtctcacatgtcttcagccctgcacaaggccaggagggctgactggcaatcccctttcactgcatcctgcagacaagggaattcagtgttagaaagatccaccaccactatggcccaagtgctctctcccctcctttgggctggtccatcacagttcatctgggagggaagggtcctcccgggagctcagagtcctgcactacattaaccaaagactcctgggttttcttttttgggatggagtcttgccctgtcacccaggtgggagtgcagtggcgcgatcttggctcactgcaacctctgccttctgggttcaagcgactctcctgcctcagcctcctgagtagctgggattgcaggtgcacgccaccatgcctggctaatttttgtatttttagtagagacggggtttcaccatgttggtcagggtggtcttgaactcctgacctcgtgatccgcccacctcagcctctcaaagtgctgggattgcaggcgtgagccactgtgcctggctaactactgggttttctatggggcaagaatatgctcagctgtgtgcagggagtgagggtggaggtgaggagtgaaggcctgaggctccaggctaagaagtagccaagtttcacctggagagaagagtagagggacttcccaaatttcttcctgaactcagctctgatactcagaaggtcagtctcacatcgagagataaggatgcgaatcaggacttggtaattgggctcagtttcctagtaggggaagaaagagatggggggtagttagtgagagtctcactgagagtaggggttgaatggcttggagggttattgtaggaaggggaggcaaggtgggagtcaagggataagagtgtacattatacattatctcgggacaaaagttatgtttgtccatcctcaaggaagatgacacagcaggaaagatcagtctctgtgggggcagcttgagtatttatttctttccacatgtctttcctgcccctaccattagcttagagctgtgtacctccagaatttggtggtgagcagctccaaagataggtacaccaggaaggctagaaaagatttggtgcatataaagactgccagcatgaaaaccaggaaaactgcttttaactttcaagttagtgaatatccaaggaggatatacctgccctatccctaaactgagctgatgaggctctgatagggttcaaggttgtgtgacttctagttctgattccaacccaatagggccatctcacagccccatctctgcatattagtttctccggttggacccttaggctgaaacattgctatcttcctcctgtacatgcagcaggcctgttttttggctaaagaaagtaatgaaaggttcagtttagaaataacaggccaggcacagtggctcatgcctgtaatcccagcgctttgggaggatgaggcgcgtggatcatctgaggtaggagtttgagaccagcctgaccaaaatggtgaaaccccgtctctactaaaaatacaaaaataagccaggcatggtggtgggtgcctgcagtcccagctacttggaaggctgaggcaggagaattgcttgagcccaggaggcggaggttgcagtgagctgagatcgcgccactgcactccaacctgggcaagaagagcaaaactccgtctcaaaaaaaaaaaaaaaaaagaaagaaagaaaaaagaaataacaggccaggtgtggtggctcatgcctgtaatcccagaattttgggaggccaaggcaagcagatcatttatggtcaggagttcgagaccagcctggccaacatggtgaaacccccgtctctattaaaactacaaaaattagccaggtgtggtggtaggcgcctataatcccagctactgaggagggtgaggtaggagaattgcttgaacctgggaggcggacgttgcagtaagctgagatcacaccactgcactccagcctgggacagaccaagactccgtctcaaaaaaaaagaaaagaaaagaaataacacaggtacaagtcatcaaaatcctgaattataattgattatactaagtaatgtgttgttatgagagatttttaaataaaaacttttaattgt

SEQ ID NO: 171 - DNA, 60 bp, Homo sapiens
gcttaatttgggtttctatctcttatttgtaatgccttcctggggtttggaaataaaact

SEQ ID NO: 172 - DNA, 8002 bp, Homo sapiens
ggtcagggcaaccgtagcgacgccggccctggctgagaggcgttaggagtccgggggttcgcccgcggaggccggggagcagccgaccatggagccccagaaaatcatgccaccctcaaagcctcatccacctgtcgtgggcaaagtgactcatcacagcattgaattatactgggatctggaaaagaaagccaaacgccaaggacctcaagagcagtggttcagcttctcgattgaagaagaagaccccaaaatgcacacttatggggatatgcaacgaagcatgttgttgaaggtctggaaccaaggacgctgtacagatttcgcctgaaggtcaccagcccctctggggagtgtgagtacagcccactcgtctcagtgtctacaaccagtgagtattcagaccgtccacactcacctctctctagatcaatggagatgacaagcaatttagaaaaaatattctgcctctcgtttggccttaccagaagcagaaatgatacaatttttaaacactgcaataatatttgctagttgggccttgccataacttgtaatgtcagggaagtctaattatgctttcacaaactgggagagctatttttgtgtcagaactgtcctgttagtagccattcagcacaaaagggtggagtcacctttcttaggaaatgggccacaggggtgtgggctgggtaagcctaagcgtccccacacagccaagcaggctgcctgcctgagcgtccttgggcaagcagctccattcagtgtcatatccattttagacaaccccagggtgtgcgtcttaactcgccacacaaacccgattcctggggtcacggtgagtgagggtgaacgaacagtgctgctgcatccacggagaatcctgtgagggagagccccacatggagacctctgagcccttcagccggctgagttttaaggttgtttctgagattggtattttaaagcattttaaagatgctatctatgtccagggccatctctgagcaagagccttgtaaaaattaggatggtcacaagtgttctccacggcccacccactgaaaacacaggcaagtaatttttcagttgcacaaaggaaaccttccttttgtgagtaaagctctttttccgttttattccaggtagcatttggcttggaggtatgtgctttccatggctttcaactgtgtcctttaggcatttcttcattacaagttttgtgtagactaaagttaactcagcttttgagttaactcagcttttgagctgtggtaccttcagttgcagacctggcatgaggggacaggatctgagtttagcaaactgggagtttatctgtgaaaaacacaatttcagaggagacttgtgatatgaaatggtcaactctggggatgcaggtaaaaaaagagggctcgttccttcatccgacagtgttgagaacatttgctgtaacatggaaggtacttacctctggggttcttaagagaaagcaaagacagcagaacatgagctctgtgtgctgaaggaaggcagagggcattgcaggagaaggggcaggaggaagaggtggcaaagggagtcaggcatatgaacagagactccgggcaaccccagccaggatgccgtcccaggctacctttctgccccctcccatcctcttgctgtccccaccgcccacaggcctcctgccactgcacactcccctacctctgcccttcttccctggagcactcacttcattgctgtgctcactgagcctgctccatgggcaagcatggcaggggcgattcctcgtgtggctttcccctcctctgtcacatgccttccctcctccccaggtacagagcagtattcccccacctctatgaacacttcttgcatcttaagtatttgtctaccttttggtctctcacctacattgcgggctccgaaaggatggacgatgggttggccatctgtagcttgtgggagttccttaataaataagtcagtgtgtgtgcctgtggcctgagcaggagtatcgcttcagccaggagttcaaggctacagtgagctatggtggcaccactgcactctccagcctgggcaacagagcaggaccctttctttaaaaaaagaagatccttgatggatggatgggtaatgaattaaagaccagtggcagaattaagagtatgaaaagaaacactgattttctcaggttgcatttatgtttgttggaagatgtattagttttccactggccagtgagagtccacccgaaccttccaggtgagggtgaatatggttggttctgcagccttccatggtgggcttcaggtggcctctagcatcctcttaatagcacaccaaagccagggcaggggcttctggccgtcctagcctgagtttacatggggttggagtaccatttggagcaattttaggaagggctgtttattagtgtgttctcacactgctaataaagacatacctgaggctgggtaatttattataaaggaaagaagtttaatggactcacagttccacatggctggggaggcctcacaaccatggtggaaggcaaagaaggagtaaaggcatgtcttccacggcggcaggcaagagagagcatgtgcaggggaatttccctttataaaaccatcagatcttatgagacttattcactatcatgagaacagcatgggaaagccccacccccatgattcagttacctcccaccaggtcactcccatgacacatgtgaattatgggagctacaattcaagatgagatttgggtggggacacagccaaactatatcaggctgtgcctgtgggccagatgtgccttctccccactgagctggctccagaggcagccatggagagttggtgcagcgcatttgtccttacagcgccatggcttccatgagtaattagatgaggcctcctgcagggatgagtgtgtggtggtgaccaggggtgtgtgtgtgtgtgtgtgtgtgtgtgtgttgggggagtgatcctggccatttcactgccagataatagatagcatcactgcctgcagccaggaagccttctcaacctcaggggggctgtactgggtggtgaggatcaggtgtcctcctcctcctagctggggcaggctcttggctctgtgggctggctgcagctcccttatgctattgtgttatatatttataatatccaaagcagattctcctaaggaggcagatcatgctaaacaaagaactaagaaggtgcacatgatacaaaatgcttctgtgtggtggtaatttgcattcagtttgagagtgttttaatgagtcacagaggcatgcactttgtttgaataaagaatgaacagcctttttttcccccccaggtaaagtacacagattcttgcttaaatgaggcttacaattttaatcagttgggcccttataaagaaagaaaaacagctgctacttgttaattggcaaatatcttctccaatgagctcgtgatttattcactgcttttaataaagacttaaaattccaccaagaaaggtgttagcaccatattataatatctgcaggtacatctgcaactaaatgaccctcttagagaacatgagcgatggcttcctcaagaccactctgccctgctctgcccttctcctcggtgtccctgctcacctggccctgactggtgagtccatctggctcacgtgagcatgggctaacatcctcaccatgggcagaatcagtttgataattgtaattgcaacactcagggtaaaacactagaaaaacccgcagagcaatggccggccttttaaaaatattcagttgcacttattgatggcattcccttgggccaggcccacaaagtcttgaaggattcaggggtgggaggaatgaaacattctgttcaccctggaatttcctctctgttcctcaggactcctgcctatagtgggagtagaaagaattgctgtgcactgcaaacaagggccttttcatttcttttctgtttctttgtcaaattcaggtaaatggagacgttttcgtacctctgtcgcttcacacaggtttcagtgtaatcctcagtccctcctttccctcttggtagtagcgtgaggacgattaaggagttaacactgagaaagagctctcacaccctggaacgatggttactgctcagcaagcaaggactgaggaacaattatgtcattcccctctcttcagtggggtgtccctttgttctcagagtaagctgtgaagtgctctttacctcccgtggaagctggaattggcattacatttattatatcctaatactaaaagccctggtctttgctacaaacggtccttaagcttataaacatgcagtgaacttgtttcatttcccaacctttgcatgctgcagagcttcctggttaggatgcgctaggaagtgtccccaccgagagagcctttctgttcaggtaagatggaggctgtggagtagaggggtcggtgtagagaggtggttggggctgtgcccttagaactttccttaacatctcaagcagttagcacgttttggaagacttttaggcatcccctttcttttttaacactttgcgggaggatcacatttacttatgatgttcatctgtattcaaaatttggtaagaatggaagcatatagtgaactggtcgatactgcagtgtttactaagtactaaagggaaggagtgggcctcatggaagacttggccttggctctgatgctgccctctcctaactgggcgaccttggacaacttagcttttctgactcccagtcttgtggtttggaggagaattttaaaagcactgggtaaaaagcctatgtacagcttaattcataggatttgatttaggatactacacattgtacaacttagtagaaatagaatgagctttatatgttgttataggtgatttatccaaatgacttgtttttatgtttgagtggcaggtgaagtttcagattaggaaaaagtggggcctgttaatgggataacagagacttttataaacataccacttttcttctcctggttagcaacagaaggggaaacagtctatgggtttagttcatccatctaaagtatagatgagacgcatcatgattttaagtccttattaatctagcccagggttctcaactttggtactactgatatttggggactggatggttccttgtggtgtcctgtgcacttatggattcttagcaggttccttggcctctatcctctagatgccagtgctccatccccttcgttgtggcaatcaaaaatgtcaccagacattgccaaatgtcctctggggtataaaaccctgcctcctttctaagcccttctagtgaaaccactgagcatggcatgaactcccttggaaggccagggacagctgtgagccttggcctttgacaggttatcgtgcgacttttatttgacacttttgatctaaaaaatgtgtagaatgatgaaaaggaagtataatgtagctaaaaaaagtctgtaagagattggctagctctagcagacaaaattgttatttcaaaataatttaaacttggcataaatttatttttatgaaagaaaggaaaaggtatcggctaaagatccttctggtagaaatccttttattctcctgtctcactgttttcccagtttgtacattgcccaattcacttggcaccactgaaaccctccgaggaaacccagagaaaaagtgtctcctatgcccaggaactggcatcccagagagattttctaccataaggagcaggaagagggaggccagctgatctttctgggccggaccataagagggagggtgggtgagccccaggaggtggcgtagggtgcagtgggggaggatggggtaagagggagggtgggtgagccccaggaggcagtgtagggtgcagtgggggaggatggggtaggagtggatattttctttcagggtttagaataacaggctgaaagcaggcactacagtgtaagtgagcatgggaactaatggttagctcttttcatgctaaccccctagagcctagcacaggacttggcatgtacattacttaggtttgttgaatgaataaatgagacctttgaggtttttttagaccagggattataaactcaaactcttgccgtttgcggatgaggggctgggcgtacagttggagtatgtaagaagtggtggggctgtatccactgacgatggtagctgctgtactgtcacccccaacaacaggttgtgtgctgggtacttacgatgtgtcaggtgctattcgaagtgcttcattggtgttatttcatttaagcttaattgtgatactttttaaaatcagaaggtgtagaataaagaacaaatgaaactagaaacgcctagaaagatgggtggcttctacatagccctttattctccctctgcttgtgctgcccgcctgcctgttggcttcgctgtggagctgatgtcccctgtacaaaggatgccctcctccccggctgtggcccattgttcttttaggcttctggactcctcctgggtcttcgctggttggcaagctctctcccctaattggcttttctcctggtgctccccaccttcctgtgggtcgaagcccttctgcccccagaagctcagagaagacaaggccaatatgtaagtcacattcctgggaagaactgaaaattttaattccaaatgttaaagcactttgtcttttttttttttccaagtagtttaacatctctttggcaaataaaactagcatattgtgacaattgctgaggttttccttgcttgtaggagacatttattaagtcttatgaaatctgaaaggattatttccaaatatcaaagtaacattcacaaagcaatactgtataacttggaaatgtcccaagctttaggtcagtcaaaatgttctcttaatatgtgaaaacaaggtcattttcggtaaaagaagcaggtgagtaggaaatgtaagatatacttaacaggaatagccaagcgccttcctgaagatgatcccctgaaggccacaggaggacgatggcgggaagcagtctccttttctgatgttctggatgactgccttccatctcatttctccaggagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccaggcttgtgaaaatcctagtttctaatggcacagacgtgaatctgaagaatggaagtggcaaggacagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatgagtgtagtctccttattagaagaaaggaaaaaaaagcagaggccaaagaagtcttgtgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 173 - DNA, 60 bp, Homo sapiens
gggggctgtacatttatttatttagttgaagattcactgatcccactttgaaatacatct

SEQ ID NO: 174 - DNA, 3375 bp, Homo sapiens
gtttttaaactgttacatattttctggtgcattgaacttttgtactgatatgaagtgacttttttctagtaatgtctttaaaagtataatttatctgatattgataattatatttaaaaaatctttacatgttaaaagctgttgtaccagctagctagcttccttccttcctgccttccttccttcctttccctccctccctcccttcctccttccttcttccctccctccctttcctttcctttctttttttttttttgagaaggattttttgtattaatgataggaattgttactgcaagtttgtatgctggtaaggatggttctttaggtgagaattgatataggggactaggggacagtgcaagaacagagagggaaatgggatccagtacacaagtagagaggctacccatagagaggaacatggacagctcattcatagtagtaggaggttcagggtcaagtgcaagtggattggtagaggtagtaatgggacaatgtttctattttctcaaagaaacaatgtcatttgctgacagtagggagggaggaaagtgaaggaggcttgaagagtgaggaatgttgaacatagtgttattgtttctagatatgtttacattctgttaagaggtggagtaatctagttaaagtaaaattttgaaaacttccttataattatgttgaactaaaatagtttaaaaatatataacaaaaataagttataaaggattcataagtagaaattccatcccctgaatgttttgtaaatgaattttataaagttataaaaatattgactcttgaaagattatttggaaaacaggaagaaacacctcctttccaaatcatctatattcctactacccaggcataacccctactcttaggcccctcccattttttttctttttaatgccaagttgtttttttttttaaatttatttatttatttatattttttattatactttaagttttagagtacatgtgcacaacgtgcaggtttgttacatatgtatacttgtgccatgttggtgtgctgcacccattaactcatcatttaacattaggtatatctcctaatgctatccctccccgcttcccccaccccacaacaggccccggtgtgtgatgttccccttccttgtctgttgttaaaaagaacagttataggcatgcttcatatgcaatttgtcattctatgcttatcagctagccctataaatatttttccatgttattacatactttttataaccatcaaatagttgggtcattatttgctgaataataccctattgttggacatttaggttaacaatttttagttgttccatataatcattttgaataaatgttcctaagaaactcattgtatacgtacctttcattacttgataagctgtgtcatatttttgaatcacataacttagaaaataattctggcttgactttttattgtgacttcatagtcacactgtgttaaagtagattctctttcctaattttactaattatatgttaggtctaaagtcaatgcaaggaggtgggtgaggtggtgcactcctttagtcccagctacttgggaggctgaggcaggaggattgcttgagcccaggagttcgtggccagcctggacatcatagcaagacccccatctctgaaaacaaaaaacaaaaacaccaaaaactgttaaaattggtacaaggaaacaatgtgtgtcctggaagtattgatgtaactttaatagtacaatgataattttataccaaattttagagtatatattcaaagtaagaaacattaatatttttaataggttgatccaaggattagttttggatcatggtgcccgtcatccagatatgaagaagcgagtagaagatgcatttatccttatttgcaacgtttcactggaatatgaaaaaacgtgcgtgttactttctctttataacttttgaatttttttttctaaaggtgttttaaaatctctttttccttccagatgtttggtgtagactacttctatcttttttcctttttcctcctgcctttactagctggtttttattaatcttttagagaggtgaactctggtttcttttataagactgcagaagagaaagagaaattggtaaaagctgaaagaaaatttattgaagatagagtacaaaaaataatagacctgaaggacaaagtctgtgctcagtcaaataaaggatttgtcgtcattaatcaaaagggaattgatccattttccttagattctcttgcaaaacatggaatagtagctcttcgcagagcaaaaagaagaaatatggaaagactctctcttgcttgtggtggaatggccgtgaattcttttgaagatctcactgtagattgcttgggacatgctggtcttgtgtatgagtatacattagtgagtatttctatgaacagtggttataaagtgaatactaagcccccttttttaaagaaaaatactacttgaccttttatttcatgttttgtgttttgagatctaattcacagaacagattttacagtttatttacctaaatgtttgttaagagttcagatataacttaactcccttagttatgcttgataagaaaaattcaaatgaagattgtattctagtataaattgttgattttataatgacatcaaatattaaagttatatatttttgtgccaccctttagggtgaagaaaagttcacttttattgaggagtgtgttaacccttgctctgttaccttgtggttaaaggaccaaataagcatactctcacacaagtcaaggatgccataagagatggacttcgtgctatcaaaaatgccattgaagatggttgtatggttcctggagctggtgcaattgaagtggcaatggctgaagctcttgttacatataagaacagtataaaaggaagagctcgtcttggagtccaagcttttgctgatgccttactcattattcccaaggttcttgctcagaatgctggttatgacccacaggaaacattagtaaaagttcaggctgagcatgtcgagtcaaaacaacttgtgggcgtagatttgaatacaggtgagccaatggtagcagcagatgcaggagtttgggataattattgtgtaaaaaaacaacttcttcactcctgcacagtgattgccaccaacattctcctggttgatgaaattatgcgagctgggatgtcttctctcaaatgatgattgaattcaaaatcaacccttctagaagatgaaatttagtacactttacatctgactactattgtgtagcctgagccattctgaatttctacacaataaatgcagtttatgtcttaaaaaaaaaaaaaaaaaaa

SEQ ID NO: 175 - DNA, 60 bp, Homo sapiens
atcaacccttctagaagatgaaatttagtacactttacatctgactactattgtgtagcc

SEQ ID NO: 176 - DNA, 1717 bp, Homo sapiens
ccggggcggatcggaagttgctttgttttgcttcgagatggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagagccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttggcctgctgtgtttattgtagagacactgttttagtaaacatgctgagcattcattttgcgtcctctgggttggatgcaatgtgagaggatggcatgccagaattaggacacgacatgaaaccagagtggtgcctctgtccgagaacttgtaagttctcaacttgggaaagacagaggtgctggagggtaggcctcagaccagggggtctccaaaactttgtaaatcatgcatcttttctccataaaacatctttcacttaatttccaataaatgatgtatttgtgctatacatacgtactgctatactataaaaaaaaaaaaaaaaaaa

SEQ ID NO: 177 - DNA, 60 bp, Homo sapiens
gggcaaggtggaatgcagataactcacatgtaaaaggaacttgggtaggtaaataaaagc

SEQ ID NO: 178 - DNA, 5242 bp, Homo sapiens
gccgcggcggtggcggagactgtggctttaagagcgtgccgggagcccgagccccagccgggccgcgcttcgccgctgcgcaccccagcggagccaagccccacgctggccggacagggccgcctgtcgccgggctgctgagaactagccctagacctctgcgtgagggttcttctgccgaagacatcaccagtgtgtggagcctgccacacccacccgctgccaaaccacggcctttacctgtgtcttccggtgtttcccgtgcgacccatcctgtgggagtgcctcgtgggctgccccagagttcaccccacactcagcagcaccaatggtgaagatgacaagatcgaagactttccaggcatatctgccctcctgccaccggacctacagctgcattcactgcagagctcacttggccaatcatgatgaactaatttccaagtcattccaaggaagtcaaggacgagcatacctctttaactcagtagttaatgtgggctgtgggcctgcagaagagcgagtgttgctaacaggactgcatgcagtcgcagacatttactgtgaaaactgcaaaaccactctgggctggaaatacgaacatgcttttgaaagcagccagaaatataaagaaggcaaatacatcattgaactagcacacatgatcaaggacaatggctgggactgattggacagcatctacccaacccagtgtccacgtgaacgccattcaaccgaacattcttcccaagcgtgagagagtgactgacacttggttccatccatttaggggccttgccatccggggcatcctcccaccctgacgccatctttctggtgaccggcctctaaatcgctgtctctctgtctctttgctttgtatctgtttgtgagttgatcctggcttctctctctgttctagttttggctgaaaacaaaacaacaaaaggaacagatccttgaccgcatggcggcagcccaccttggtaagggccccagggcccatgcgagagctgcctgatggcctcttgtcaggagagcagtggcacgggggcgtgaggaagagggaaaggggaaactctaagggtcctggcgcggggaaggggtggaagggtggaggtaggaacaaaattgcgccgctcctggagacctgataacttaggcttgaaataattgacttgtctaaaaggacaaagagaaaaaaaaaatacctcatgactgcattctctctgactagaagcttctgttcctgacaccaaatgtgccaggttagcaaatgagcacaagatgtggccctgattctagttggtggggcaagggcctggttctcctgggctgagtgggggagtgtcctggcagcagcgagtgacctgggcagtggccaggtgggtgcgatgactctgatgcctcactcagtctctgggcaatcatcatctttgcctctagccaccgtagataaggtgtgaagggactgctgtttgcaatgggcttaccatccaaatatcccaaaggctttgaccagcaaccaagtaaaatcagtaattgaggagagcagggcacaaaggggctgcagtttgggagctcctgaagaaatggctcagatattgagtcagagaaataaaaagtaggatcagttagcaattctaactgcccttccttctgacccctcataagaggagtgtggtgagggaggggactgggtaggggtcatcccaggaggaggggtttacattggaaccagttcaggttcggtgcatctttcctcttcggttttacagtggcttccgtgggatcgtcaatttcttgttcttagagtttcgggtgtttttctccagtcttgttactgtagactgtagaaagcacgggccccaggctctgagcttagtaataacctggctggtagattcctcatgcccctaattgtcccacttaggcctgaatgtcttgcatggagagaaatctcctgtcagtgtggtccagcagcagggaggagttctgcccaaattccgatatcaccccttcccccatccaagcatccttcgattagggaagtggagagcacatccctgtaaggcccataagagaaagaggagtttgttacatttaatcaacactgtgaagtctgttctacagcaattcagccattacacagtatatgactgaaactcatttaactgggttaatttcatttcttagactgaatatattattgttaagatacgtgtgcgtgttaggtaattctcagcatctcctccaagtaggccgaccttctcggaaaattcaccctaaaagtctcacaaaagaatgagttcatggggagattctgtaaagtgatgaactgagatgaaagcagccaacagcccaggagcttttcagaatagcgtctgcagcagaaccagtttccattcagagcgcgtccttggtggaaatgcttttttgtgtgtctccacgcgctgatggtggaatgggagccccaagacgtgtgggcttagaaatcaacttttgttccccaaggcttcttgtccagatctttccagtgctttcatagccctgggagatcaagttgttctccccactttactgcaaggtagactgaagttcagaagaaatactgaatttctgctcccagaagaatagtttctctggctcacaggcccaagttctcaatgaaatcgttttttaactttcacattcctaagctggcttcccggcacagaagccatggatttcccctctctcccttccccctcctcaaggaaatagtcttcctttatggattttcattggactctttcctcagcgattgtcctggctgtttattgatagtccttcccataagaaaatggggttaaacatggggtaggtattttgtctttcaaactacaaatggaatgtggtgacataaactagacatggggtgccctcaagtttccaaggggaccaatgtgccactgttcttccttggggatgaggcctttgactgttggatggatcagagcaggctccagtcagaccctggttctgaatgttttttttttcggtgactatccagtgagccttcagtgggtgcaaggcgccatacttgctgtgagagagctgagtagagtgttggtttttccataactacagggggaaaaaaagtcattaggctttccctttgtgtcagtgaaaccaaaagtgcttcttacaacgttcgctctgttcatgggttgtctatctaacattgagcagcattggagaggccacagctgagctatggagatgctaaattaactcatggcctcagtcagttcattctttaatttcctcaccaaattattgacttagagcataaccaaagacctcattcattcaccccaggtgggttggggtaattggagtttgttggtgaagtttgggggcggggtgttgggagtagagacagggtaaggggacgtgagaaaggaaaaggcatgaagttctatacctcagccagcagctgccttcgtttggaactgaagtccagccagcagactctctagctccatctcccctgtgccaccctaggtcatatgaccttggccaccttggagtagacccagacccctcgggacccgggacattagtctcaggctgctgatggattgatttgacatgaaccaaacacagccaaactcgatacccacaagctgtcagctgaacctgactgagtgttcttcctgagttcacgaggataggctagagtgcatttttactggtggatcagtgtgtgcgaaagagatgaccctttataaagagattttcaagtggatatatataaaagaaacagttgcttgtaaaatatacttttgtaaataatatttaattttttaaataatatatttggtgctgttttctcagatcccctgagagcactttttattttccttttaaattctatggtttcctttgcatttcttgaagtatattttaagggaaacagtgatcaccaatacatgttttcagttttttttttttttaaggtctctatcactttaatctggatcaaggctttgaagcaatgcctctctgcattttttccccagtggaacagactctgcagtacattaatcaggttgagaattgaaatattttcttgcatcagtattggctagaaaagaaaataaataaaaccaagttaatttagtagtaacaacttacagtgattcttcctgttggaagaatttccaacaaatcagaatcacgtttttagttgtgcgtgtgcgcgcacacgtgtgtaaaaagcactttcgattgtgcctcctgttttctcgagtggggacactttaactacagtttacacctcgggcgcataaagtttttcttctctttctctctggttgtttctgtttctgagtggaccaacagcagaacccacgaggatttgttttgagtatggagctgttgcgggtttgctcctttttcttgctttgcgtgctcagtttttacagactgtaaaggagatgtgttgtttgtgaagatggagcagagtcaaatctgtgcttctaactgagatgagagtgtattaatcacgtatcgcagggctccagctgttttagaagccacatcatgttaaacattaactggtttggattaaaagaacattaatattataatacacatatcttagtggtaaacagctttttttttttaaggtcagattgcctcaggtttagaaagaggctgagaaatcaaatcttgaacacaatcaacttacatattttaaaggaatctgcctcaaatgagaaaatatgctagttatctagatagaggaaagagatatttacttttttaaaaattaaaatagttatgaaatctggcagaaaaggtaaagcctagaagaaactatgaaagctattctcatgttaccaaattctatctgcgcatatgtttttgtataacatttcggtgacagtgggagtcggttccctttcccaacctgcagagactatcttccaatacagaatctgtctatttatgcttgtgtttacaaactgtatttgttgggtttgggtttttgttttctttggtggcatttttcaggtcactttgcttctataacaaaggtaattgttttcaaataatttgtcttcaccttttcctgtatttgtacatagtgattcagtattagagaaaagtgcattgtttctgtcatatttccaatctgtgttggtgctcatttgagaaaataaaagttttcaaatattaactcttaaaaaaaaaa

SEQ ID NO: 179 - DNA, 60 bp, Homo sapiens
gtgattcagtattagagaaaagtgcattgtttctgtcatatttccaatctgtgttggtgc

SEQ ID NO: 180 - DNA, 3020 bp, Homo sapiens
cagatcctttagtgccgagcattcaaaacagtgataatgcagtgtatggacttttctggattcaaattcaaacaaaccaacagcaaaggacattttggagagaactggggaaaaccaaatgcagtataaattacaccaaggaattattgctcaagttgttgattgtgaacgttttattacaattatcttttagaaggccttacctattaaaaatacttagtgaagtatttaaaggaaaaaaaatgatgtctgggatttgtttcgaatgttccggatgtatttatgaattactttttcaaagaggaaaacttttttaatgaaaaaaaaaacatggagacacatggtggcgctacaggataagacgaaaacagtacataggctggcacggtgagcttcgctattcaggagaacagaaagcatccaacccactgaaaagacaggcattaaaggagcttcgcctacagagctgctggaggatacactctccagggggttcctgttaaaaaccagagcttcagcttccaaaattacggctgagcttcagtttttccacaagagattgcctaaaggaaccatggagatcagaggggcactcgatctgcgaaaaaggcaagttctaatattccttgttttgctgggattgtctcgggcaggtactgaatctgcacactattctgtggcagaggaaacagaaattggctcttttgtggctaatctagcgagggacctagggctgggggtggaggagctgtcttcacgtgaagcccgggtagtgtctgatgataataaaaagtatttgcaccttgatttgctgactgggaatttgctcctaaatgagaaactagaccgagacgagctgtgtggctccaccgagccctgtgtgctgcattttcaggtggttttggaaaaccctttacagttttttcggtttgagctgtgtgtcaaagacataaatgatcactcccctacatttctagacaaggaaatacttattaaaatatcagaaggtaccactgttggagctacctttctaatggagagtgctcaagatttggatgtcggaagcaacagtctccaaaactacacaattagccccaattctcacttctacattaaaattcccgacagtagtgacagaaagatatacccagagctggtcctagatagagctttagattatgaacaggaagctgaactcagattaacactcacagcagtggatggtggatccccgcccaagtctgggacaactttggttctcatcaaggtgttggacatcaatgataatgcccctgagtttcctcagagtctctatgaggtgcaagtccccgaggacagaccccttggctcctggattgccaccatctcagctaaggatctggatgcaggaaactatggaaaaatatcttacacatttttccatgcatcagaagatattcgtaaaacatttgaaattaatccaatatctggggaagttaatttgagatcacccctggattttgaagtaatacagtcctacactataaatattcaggcaacagatggtgggggtctttcaggaaaatgcacccttctagttaaagttatggatataaacgacaacccaccagaagtgaccatatcgtcgattacaaagagaattccagagaatgcctcagagaccctagtagctctttttagtatcctagaccaagactctggagacaatgggaggatgatttgctctattcaagataacctccctttttttcctgaaaccgaccttcaagaactttttcactctagtttctgaaaaagcactggacagagagagccaagccgagtacaacatcacgatcaccgtcacagacttggggacacccaggctgaaaaccgagtacaacataaccgtgctgctctctgacgtcaatgacaacgcccccaccttcacccaaacctcctacaccctgttcgtccgcgagaacaacagccccgccctgcacatcggcagcgtcagcgccacagacagagactcaggcaccaacgcccaggtcaactactcgctgctgccgccccaggaccggcacctgcccctcgcctccttggtctccatcaacgcggacaatggccacctgtttgccctcaggtcgctggactacgaggccctacaggagttcgagtttcgcgtgggcgccacagaccgcgggtccccggcgttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagcgagcgcgacgcggccaagcacaggctggtggtgctggtcaaggacaatggcgagcctcctcgctcggccaccgccacgctgcacgtgctcctggtggacggcttctcccagccctacctgccgctccctgaggcggccccggcccaggcccaggccgactccctcaccgtctacctggtggtggcattggcctcggtgtcgtcgctcttcctcttctcggtgctcctgttcgtggcggtgcggctgtgcaggaggagcagggcggcctcggtgggtcgctgctcggtgcccgagggtccctttccagggcatctggtggacgtgagcggcaccgggaccctgtcccagagctaccaatacgaggtgtgtctgacaggaggttccgggacaaatgagttcaaatttctgaagccgattatccccaattttcaagttcatgacactggtaggaatatgggggaaatcgagaactttcgaaatagctttggacttaacattcaataaaacaatttattttaaatgtctaaaaaaaaaaaaaaaaaaaaaaaaaaa

SEQ ID NO: 181 - DNA, 60 bp, Homo sapiens
aaagtattaagagctaatgtcattatatatgtaacttaaatctagacaccatcaaagcat

SEQ ID NO: 182 - DNA, 7331 bp, Homo sapiens
gttgtgagctgcggcagagactggtggctggaggagacgccggcgctggagagtgcgctgcgccgcccgccgctgagggaccgcggggttagccactgctggctgcttccagtgttcgccgagaggtaccgggggtgacagctccgggaccggccgaaaggcgaggaaccggtgtggaaattaaaagaacacacatattttgactggggctttgatcaaccaaatgctaaaaagccacataaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagctgaagctatggaatgttttttgcagtatgtttatactggaaaggtgaagatcactacagagaatgtacagtatctctttgagacatcaagcctctttcagattagtgttctccgtgatgcatgtgccaagttcttggaggagcaacttgatccttgtaattgcttaggaatccagcgctttgctgatacccattcactcaaaacactcttcacaaaatgcaaaaattttgcgttacagacttttgaggatgtatcccagcacgaagaatttcttgagcttgacaaagatgaacttattgattatatttgtagtgatgaacttgttattggtaaagaggagatggtttttgaagccgtcatgcgttgggtctatcgtgccgttgatctgagaagaccactgttacacgagctcctgacacatgtgagactccctctgttgcatcccaactactttgttcaaacagttgaagtggaccaattgatccagaattctcctgagtgttatcagttgttgcatgaagcaagacggtaccacatacttgggaatgaaatgatgtccccaaggactaggccacgcaggtccactggctattctgaggtgatagttgtcgttggaggatgtgagcgagttggaggatttaatcttccatacactgagtgctacgatcctgtaacaggagaatggaagtctttggctaagcttccagaatttaccaaatcagagtatgcagtctgtgctctaaggaatgacattcttgtttcaggtggaagaatcaacagccgtgatgtctggatttataactcacagttaaatatttggatcagagttgcctctctcaataaaggcagatggcgtcacaaaatggctgtcctccttggtaaagtatatgttgtcggtggctatgatgggcaaaacagacttagcagcgtagaatgttatgattccttttcaaatcgatggactgaagttgctccccttaaggaagccgtgagttctcctgcagtgactagctgtgtaggcaaactgtttgtgattggtggaggacctgatgataatacttgttctgataaggttcaatcttatgatccagaaaccaattcttggctacttcgtgcagctatcccaattgccaaaaggtgtataacagctgtatccctaaacaacctgatctatgttgccggtggactgaccaaggcaatatactgttacgatccagttgaagattactggatgcacgtacagaatacattcagccgtcaggaaaactgtggtatgtctgtgtgtaatggtaaaatatatatcctgggcggaagacgggaaaatggagaagccacagacactattctctgttatgatcctgcaacaagtatcatcacaggggtagctgcaatgcccaggccagtgtcctatcatggctgtgtgactattcatagatacaatgagaaatgctttaaactctgaagacaggatacctcaccgaagaagccacactgatccaagatgggaggttttaaaaactctacagtgggaacttcacatatctcctttgtgccatatgcaaaaaatagtaaaaataataatttggtgcctttctcctcaaaatatcaatctttcaaactataataaagcctttcctataattgaaaaaaaaaacttttttgttaaaggtaatggtggttgttacttggcctttgaagagtgtacctttgtaagtatttgtaagaagtctatgtgaattaggaaatgtctgtctgcataccttttaggagcgtgtgaatggtgtcttcacttattatgtatgtttatctgtatgtatattccttattttgtcatatatgtagagaaaattgcatgacttgaggcatcatttaggttgaagaagttaatgcttaggatgcattctaggagaaaaaatcagttttaaaaacctttgttgttaacaaagtatatccagattggttaattttattgaagggtttttttctgtaattgataaaaatgtaatgacaacaattcaggcatcataaaatactgaactattgtgactttattcttagaattgctgtcttacattaaacatgtttttagggggaagttaggtaggagatagaaaaataagtgcccctacaagggggattaaaattacaagttaattcctaagagaaaaatggaatggcctttgaaggaaaaatgacccactatggctctcaaagtttttatgcatcatctcttcaatcctctaagaaagcctcttttcttaacttgataaagcagtggaaacccattttgcaatattgttttgtgaaaaacagggacagacagccaggtacagagactcacacctgtactcccaactactcagcaggctggggcaggaggattgcttgagcccaggagtctgaggctacagtgagctatgaacgcacacggcaccctagcctgggcaacaggttgcgacactgtctcaagagaaaagaaaaagaaaaatagggataggttttccttcctagcccagtagagtttgacctcattagtatggtgctttgggtgaggacctcttccttgattatcccactttctagtgaacagctaaaattcctgagagtctctactgttaaggtacctttaataggataaagcagggaccacctatctcagtgggtccatttttcttttaaaattagttatctgaaaaaacttagcagtagttcccatctttaaggtaagtctttcatttggtccccattgtgtaaaatactaatcaacattttcaagcttctgtacaacagactgcttttgtctagatttctcaactccactttataaagcttatcagttttcagagaggaatgtgaattttttttctaatgcaaataaatggatatggcaggaactacagcataagtgattattgtgattctgggtggacggatataatttacaacatttagggatgttctaggtagcctgctgtagtttgacttccagtcactgttgtctttcacattataatttgtatatttcttgtgatagaagggatgatgcaaatatgtaattaaagtgtcaccagatttctgttaaaaccaaggttgaaataaaaagcctaacattggtaagctacattgttttctcattttagaatgattcagagatttcagatagacattttttaaactttaatgcttagctagaatctacattctgaggaaaactctaaaaaacttaaaaatttttagggaatttttatttttcaaatcataattttaaaatgatagataccattttgtgataacaacaattcagaaaacaattttctatcctcttagttgaaagaatgtaggtacagtttggatacttgtactttaattttagagtaaacatctgcattatactcttatagataatagaattatttagttaagaaattctttacagtaaatgagataatgtgtgaaaaagtattttgtaaatgctgaggattctacaaatgatagttgttattttcatgtgtatttgtaagatcatgtccatttcatgaatataggacttcacataaaaaaagactttctcaagacaactttatattctagtatttttctgttgtaaaaagtattaactatttacttttattttgttatacatttattttaatatccatgtgtttattatagtaaatttgaaatgaaatcctgaaaaacagaatttttttaaacacagacctcacaccaatattaattttttctctacataatttaaaactacataaattaagtacttaaaatttatattgaaggccaccaagaacttaggttgaatcttagaaaatttaaataactatttttaaagttacccaacttaatattttaattttttaatatttatcttcctttactaattcttgataaataatagcattagacttgataaaataaaaaagaattttagagtagaattaatatatcaaaaggggtatatcaaccaaattggtgtcagattgtattcattctctcatcacataaagatttttcttttgataggtgatgctcatatgaacctttggtttagaatctatatatgtacatgtgtatgtatgtagatagtatggttgtatacacacatatataccaaacaccatgaattttagcagtctgtgatgatcagcaaaaaagcacataaagtaaaaattagttgaccatgctaaattcaattctggaatttttttttatttgggcatttctagaactttttacatttgaaagtacatgatgagtattagtaacgatgacttatgtataatcagaatctttatgacaatttagttttacaaggtcagaagagatgagtttgctaaacccagctgtgatacctcagttggaaagggaattcaaaggtatgctttgtagaacagaaaagtatagtttttttttcatgaactttaatcattttctgtttttcctctatgtgagtcagctacaaaagtggtctaatttttacaacagtagaacttcctccttttctactgtaatcttcccactgactttactgcacaggtatgaaatactagtgtattggatcttcagtaacctttttatttcctagatgattgaaatataggtatttactccatttaaaccaggtgataagatgatgtaaatactcagggagggtattaacttgttacttttgctcgtttggggtgtaaagtgccatgactgaataatcttcaattcatgattctagagtaagtttaatttggaaaaaggggcttcacacatggtggtggttgaacattgattcttttatacttaaaaagatgaaaatgttttgtggactgatacattttatcttactgaatatgaattgtttatgtatctctactgtcaaatagcctttttgaaactcaggaaagacaaaggttcaattacaccacttttgtcaataagcaaaccaggtattttttttttctcctgttgtctggatatggcaatagattttttaaattgctgtgagaacccatatatgaaaagagaggagttgaattgtgtgtgccttttatgtcttgagatttatatgtggaaaagacgacatctacttcaaactgtatttttttcgtttttttttttttttggggaaggggggagaacggggtcttgctctgtcgcccaggctggagtgcagtggcgcgatctcagctgactgcaacctccacctcccgggttcaagggattctgcctcagcctcccgagtagctgagaccacaggtgcgtgccaccacacccggctaatttttttgtatttttagtagagacggggtttagtagagacggatcactcctgaccacgtgatccgcccacctcggcctcccaaagtgctgggattacaggcgtgagccaccacccccggcctgtattttcagagaggagagcttggtgtttttgtggtgccaagtggtaagataatgtctctttgaggcttcctatggactgcctttattttagtaaactcaagacaccagttaacctcaacagagttttggccttattagaatttgttgtgcatcttattgaaagccaggtttacatcacctcaccccattattctttttagttaaataaatttaccatgccaagtaaccagaatggagcaaattggttgatctttaaggcagtaggtttgactagctagctatcattattgtcacatctaatgctaggcaccagaaaccatttgagccaggagtgtgaatgaataattccagagacactttagacattttttaatgttttatatgaacattttacatttgtgtgattgccttagatattaaattttcctagtgctgataaaaacagcaacattcataacttattttatatattgttccaaagaaaagaatttgttttaatggtttcaaaataactgcacctgaatttgtttatgtgccttaagttctctagtgctatttcaacttttttttcaatctaaatgaagcttaccttagataaggttcatatttgtttcctatagagtaaataaacttccccttcttaaattgtgtaataagcaccaacgtgtggttgcttggcagaatgagaatgttaagggagattgttggatgtttggagtttcattatattttttgtttttattttttgatacctaggtgctttttaaaatattcagacaaatatctatcttacattgattaaacccgtgtaaattcatttgcagtatctacatcgaatgtcaaaaaagtatacttatttttgttccatacttatgtacaattttttccctcttcaggctttttcatttacctttttgaaaaagcacttactctccccttccctatcacccctcccccaaggtttctttatttaaatttttattgagagttgttggagctctaagacaatacaaatttagagttgaacaaaagtataatctgctttacaactagtatagacctaaggtcatttgctttcaattagaggctccagagtcttcatagtggaaagaatgctttgtatttaattgttcttagttaagttgtagcacgtgaatacttacttacatgttttgtttaaatatacttcttgcatagtttaattttttaaaagttgtatctaataaaatgtcttttaaccattattacttgactatatggttgtattaaattttgtttacgaaaaa

SEQ ID NO: 183 - DNA, 60 bp, Homo sapiens
agtataatctgctttacaactagtatagacctaaggtcatttgctttcaattagaggctc

SEQ ID NO: 184 - DNA, 2061 bp, Homo sapiens
tgttccgcgatcttctcaggctctcctagcagcatccatcgccgccaccctatcttcactggcttcaccttctccttctctcttcgttgctgagcgacaagcttcctagcgctatgactgtcgtctccgtcccgcagcgggagccgctcgtcctgggtggccgccttgcgccgcttggcttttcctcccgaggttactttggggccctcccgatggtgaccacggctccgcctcctttaccccggatcccggacccccgggcactgcccccgaccctcttcctccctcatttcctagggggagatggcccgtgtctgaccccccagcctcgcgctccagcagctctgcccaaccgcagcctcgccgtggcgggaggcactcctcgggcagcgccgaagaagcggcgaaagaagaaggtgcgggccagccccgcagggcagctgcccagccgcttccaccagtaccagcagcaccggccgagtctggagggcggccggagccccgcgaccggcccgagcggagcgcaggaggtcccgggcccggccgccgccttggccccgagtcctgcagccgcagccggcacggagggagccagccccgaccttgccccgctgcggcccgcggctcccggccaaacccccctcaggaaagaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaaccctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatattttgtaaatactgtataccatgtattatgtgtatattgttcatacttgagaggtatattatagttttgttatgaaagtatgtattttgccctgcccacattgcaggtgttttgtatatatacaatggataaattttaagtgtgtgctaaggcacatggaagaccgattttatttgcacaaggtactgagatttttttcaagaaacagctgtcaaatctcaaggtgaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctggttttggtatatatccattccagcttaatgcctctaattttaatgccaacaaaattggttgtaatcaaattttaaaataataataatttggcccccccttttaaaatagtcttgactctttgtgtgtgactgtttctcatgtttgaatgtgtgactaggagatgattttgtgtggttggatttttttgacttctactttactggctgagtgtgagccgccatgcctggccataatctacattttcttaccaggagcagcattgaggtttttgagcatagtacttgactactctagaggctgagacgggagcatctcttgagcctgagaagtggagattgcaattgagctaggatcaggccactgcactccagcctgggtaacagacgctgtctcaaaaaaaaggccaagagaaagtaagggagacaga

SEQ ID NO: 185 - DNA, 60 bp, Homo sapiens
caaggtgaagatctaaatgtgaacagtttactaatgcactactgaagtttaaatctgtgg

SEQ ID NO: 186 - DNA, 2434 bp, Homo sapiens
tgtctgcctggtggccactagagacagcccagcctgggccatggaagaaaacccgaccttggaatcagaagcctggggctcctctagggggtggctggccccccgggaggccagaggaggcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcacacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgtgctggcctctgtgctcatggcctgcatgacgctgctgcccacctggttgggaggcgctcccccaggccctcccggccccgacatctcctcgccctgcggctcctataacccccactcccagggcctggtcacctttgccacccagctcttcaacttgctctcgggtgagggttacctggaatggtcccctctcttctatggcttctacccgccccgcccacgcctggcggtcacctacctgtgctgggcctttgccgttggcctcatctgcctcctgctcatcctgcatcgctcggtgtctgggctgaagcagacactgctggcggagtccgaggctctgaccagctacagccaccgggtgttctcggcctgggacttcggtctctgcggggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctttgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagacagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctgaaaaaaaaaaaaaaaaaaaaaaaaaaaaaaaaaaaaaaaaaaaaaaaaaaaaaaaaaaaaaaaaaaaaaaaaaaaa

SEQ ID NO: 187 - DNA, 60 bp, Homo sapiens
gccacgtccctgactctcgggtgatcttccttgtatcaataaatacagccgaggttgctg

SEQ ID NO: 188 - DNA, 3674 bp, Homo sapiens
agtgggcccgggcaaaggcggggatctaggcgccgggacaagtccgcgcacggccctgcccacgtcctctctccttggcttcgtccccagcttccggaactgctgcggggagttgcgaactctggtcctcttggcagtatcggcggtgcgcctgcctgcctgctgtgactccagggactctaaaaaactctcagcgtaggcatcgggaaccttcgtgccaaggagccatgctgccccgatgggaactggcactttacctacttgcctcactaggcttccacttctattccttctatgaagtttacaaagtctccagagaacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagcacagaccctggattctcatgctctatgggatgtgggcctgctggtgtgtgctggggacccctggtgtggctatggttttgctccataccaccatctctttctgcgtggcccagttccggtctcagctcctgacgtggctctgttctctcctcctcctctccacactgaggctgcagggtgtggaagaagttaagagaaggtggtacaagacagaaaacgagtactacctgctgcagttcacgctgaccgttcgctgcctgtactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggaacatgactccctgaaggccagcctgtgtgtcctggccctgggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcaatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtccttgttgctggcccccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatgcttcagcccctctgtaggaatgagaccaagccacagctgtcttttgaattacgtagtcgaagaagacggtagcagccctgtagcattctaaggcatctatacccaaggagtcctgtgatttgagcttcagcagggtgatctacatttgggtgcttgtttctgagatttgcagagaagtataacatggtagttcctctaccttacagttaatcgtttcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggattttttttttttttttggagtggggaagggtataaaggaggcttaaaatttgaatccataatatatctaattacaggagaatttacaacatctcaagtacgtaaattaagttgtttgagtgaaaggttcacttggacctagtgctgcctcctgtttattacatagcatggcccttatgtcttgtgttgaggttatcatctcaatgaggcttaagctcctagagtacaggaccattttgttgattgtctttcttcatagcttctctgcttggcaaagagatgggagggggccagatactgactacctggggtaggcacattatgtgttaaagcaagacagaggccagagaggggcaggtagacctgcatagcagcagcctcagcagctgtcttggtaaaggagagagagagacatggggccagtaattccggggtgctcagaagttttaggagggaatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgttttaaaaaaaaaaaaaaaaaaaaaaaaaaaaaaaaaaaaaagaaaaaaaaaaaaaaaa

SEQ ID NO: 189 - DNA, 60 bp, Homo sapiens
tttaaactattatatgattcataatggttctcaggaattaataaatgattactgtgttta

SEQ ID NO: 190 - DNA, 2471 bp, Homo sapiens
cacgctggttttccggggccgctccatcgcgccttcctcctgcgcctcgcttctccggtccagccgccatcttcctttccgcacaggggccgccgagcggggccatgcagccaacgctgcttctcagcctcctgggagccgtggggctggcggctgtcaattccatgccagtggataacaggaaccacaatgaaggaatggtgactcgctgcatcattgaggtcctctcaaatgccttgtcgaagtccagcgctccacccatcacccctgagtgccgccaagtcctgaagacgagtagaaaagacgtcaaagacaaagagacaactgaaaatgaaaacacaaagtttgaagtaagattgttaagagacccagctgatgcctcggaagcccacgagtcctccagcaggggagaggcaggagccccaggggaggaggacatccaaggcccaacaaaggcagacacagagaaatgggcagagggaggcgggcacagccgagagcgagcggatgagccccagtggagcctctatccctccgacagccaagtctctgaagaagtgaagacacgccattctgagaagagccagagagaggatgaggaggaggaggagggagagaactatcaaaaaggggagcgaggggaagatagcagtgaagagaaacaccttgaagagccaggagagacacaaaacgcttttctcaatgaaagaaagcaggcttcagctataaaaaaagaggagttagtggccagatcggaaacacatgctgccgggcattctcaggagaagacacatagccgagagaagagtagccaggagagtggagaggaggcagggagccaggagaatcacccccaggagtctaaaggccaaccccgaagccaggaagaatctgaggaaggtgaggaagatgccacctctgaggtggacaaacgacgcacgaggcccagacaccaccacgggaggagcaggcccgacaggtcctctcaaggagggagtcttccctctgaggaaaagggacacccccaggaggaatctgaggagtcaaacgtcagcatggccagtttaggggaaaagagggaccaccattcaacccactacagggcttcagaggaagaacctgaatatggagaagaaataaagggttatccaggcgtccaggcccctgaggacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacgtgcctatttcatgtctgacaccagagaagagaaaaggttcttgggtgaaggacaccaccgtgtccaagaaaaccagatggacaaggcaaggaggcatccacaaggtgcgtggaaagagctggacagaaattatctcaactacggtgaggaaggagccccagggaagtggcagcagcagggagacctgcaggacactaaagaaaacagggaggaagctaggtttcaagataaacaatatagctcccatcacacagctgaaaagaggaagagattaggggaactgttcaacccatactacgaccctctccagtggaagagcagccattttgaaagaagagacaacatgaatgacaattttctcgagggtgaggaggaaaatgagctgaccttgaacgagaagaatttcttcccagaatacaactatgactggtgggagaaaaagcccttctctgaggatgtgaactgggggtatgagaagagaaacctcgccagggtccccaagctggacctgaaaaggcaatatgacagggtggcccaactggaccagctccttcactacaggaagaagtcagctgagtttccagacttctatgattctgaggagccggtgagcacccaccaggaggcagaaaatgaaaaggacagggctgaccagacagtcctgacagaggacgagaaaaaagaactcgaaaacttggctgcaatggatttggaactacagaagatagctgagaaattcagccaaaggggctgactgtcattggagcggtgggcactgttaagaagcagccatcacatgatctgtttttcaccacttcactgaaagacaccatttatatacccaagggcagaaagtagaacttactattcattaaatgtttgacacaattggaattgtctttaatttctgtcagaatgctattgaaaatgtgaattgcatgacttgtagcatattcttttctgcaaaatagacatattaacatgcttatgacaatgactgtgctactgtctttggaaaaatgtttgtctcagttggaaataataaaagattcacctgagaccaaaaaaaaaaaaaaaaaaaaaaaaa

SEQ ID NO: 191 - DNA, 60 bp, Homo sapiens
gactgtgctactgtctttggaaaaatgtttgtctcagttggaaataataaaagattcacc

SEQ ID NO: 192 - DNA, 6576 bp, Homo sapiens
gcggccgcggcggcggggagagcggagggagcgccgcccgcccgcgccgtcctttgtgtggcggcggcggcgcctgggcctgaccgggtccccggggctgagcgccgggctccgcgccgcccctcccgcgcccctgccaagcgggcgcctatcctctccgagcaagatggcaaccccggcggcggtcaaccctccggaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcattgctccactctcccctgcagccgcggctgctcggccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagccctcgttctgccagctggagccaagaagcacagagacacagaggcgcctgcccctcagctccgctggtctgtctgtgcatccactgtgccgtgggacatatgtaatttgtgcagtgtgacatggacttgctgtcctaatggatgtgttgtgccttgtgtctgtcatgtgtggccagcgtgattgtatagaatccagagtatgtagagagccaaaatgtgtggccctgtccccaagctcagcaccaccggccatgaccagaggttgctcggcccagggtctgggagctgggctaacaggctgacacttcggcagggtcaccaggaggcacagctaggggcatgctcacatgggtaggtcagttctttggtccaagcctctggtgcagattcaagctcctcctcttagaggaagcagctccttcctcccacaggagccccaagggagcactcaccctcctcccaattggatctgaatagctgtgttcctgatcccacataagcatgtctcatccttgccccactggtgagaggaggaccttgtgcctgcccagagcctgcaggacagcacgccttgaggtcagaggcctggcccttctttacagatgtagatagcagggtaggacgcccaggccttctcacatgggcaccatgaaacactttcttccaggccacctgagccttcgttcttcagcccgactggaggaacagcagctctgggaggcacagagtgcaggtctcaggggcagaagacatgggttccagttctggttctgccacacacccaccggccttgaatttctctggtggtctcaagacaagaacaagagctgactctagaatcttctgcctggctgacctctgagcccatgatccctggcttgctgtgcttctcttggatttgaggagagtttatgaatccatccccctgttttcagggacctctgccttctcccacaccccttacactagtgaggactccttcggcctcttgtgtttccttccttttgtgaccattacgccccctccctgtttcttatcaccagcccatcagcccactgactcccatatggtagaaaaggtaccgtggctgctgcagggcacatggagggacctaccctctgggaaagcccttgtgtccctcccagagtccttcaggtaggccctcgcagatgctgcttgctcagaaacaacccgtgcatccctgcccatggattctgcaggacctagaagagtggcattggttctaggaacctgagagtggagtgaggccagcatgcaggaaggagtttggagagagtgtttgctgtgatccattgaaagctccacattaaaccccagccctgtctggccagggagatccatgtgctcaatgttgctgggggacctacaaaagtcaaacattgctcagtaaaatgcctttggctggtcgccagctgtgcatgactgcagttcctagactctaacttaaccccaactttgcagtttctagagctttttgtctgtaatggtgattgggtctccactgtagatgcatgcagtgttcactccaacctcagaggctttcttgcttctggggaaatggcaggtggttgaaaccctgcacatcctcccagggccagccccagaatgggcctttctctgcctgccctgcccttggggccacctctgcctccagcaggcttgagcttgccccaggccttgggcataattatttccccccaaaaaaggcacaaaaataggttttggatcaaagaagtgtttctcagtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggagaggatccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacatgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagaggcacttgtgactttgtttgactctgtgactcacttcctcgctcacaccttgtttgaactactggactttcaactggctttccttaggtcaggcaagcagacagctccccactgaagaggtctgtacagtgacaacccgggccggcagcaaggacacagatgcagccacagtaaggctccatcaggactgggtcagtgatggcaacaggatggccaaggatggctctagaacactctgtccatgcgtcactccccccagttttatttttagctttggcttcagggagtgacagccatcacaaatagccacattctgctctactctccaacataccagattctacactgttgttatttcatgagacgtgaatgttgcagagagtggggggattctggttgttaaggaacttacactggggagctttactcttccgtgtcaacaatgtgactacatgttctccagattagccacacatgcaaacatcagtgtccttctagctttagccgagaaagaaaccagtcccagggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagtacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctgaacaacaaaaaaaaaaaaaaaaaaaa

SEQ ID NO: 193 - DNA, 60 bp, Homo sapiens
gttctctatgactaacagttattaagtcggttgtgtatatgtgtaactaatgtaactgcc

SEQ ID NO: 194 - DNA, 4877 bp, Homo sapiens
agctatgcaaacacgctgcgagcggccttgagagcccgaggagggtctgctttctgggcccctgcagagggcaggggtcgcgggctggtggtctgccccgcccagagagaaagggccttggcttcccctcattcttcgttctgtgttagctctttttattgcaaataattaattaaagtcagtacagcaagagtgggaaagtggttaatgcaattgccaggtccagattcagagggatgaggcgccgaaaggaaagacaaccttgggatcgcttccacttcctccacttcgcaccgcatggccggcaagttggcggctctcgcctgctcccagttttcccggagttgagtatggttgactctgactggaccaggttgggtcacgtgtcggccctgagccaatcagcttgcccagagagatgatgcgccctgagtggagggtgaacctggtgataggccccagagtggccagagaggaagggcatgcgcacaccatagacgtaggcaacgtggtggacgacatgggggctgggcgggggtgctgctcacccaccttgtgcccagtgctttcccttccccttgtccatggtcccctagcttggggagaaagcagggtgcttgctctacccgccagtgctgtctcggggctgcagggagttgtggctgccctgcttgcggtcttcactcccaactcactgtggctttgcagagctggagtccgccctatctgggcttgggggtctgctccctgagagcattatttggtgcccctcgactgtgttgattcagaaatctgggacctgttgtttctcgactaaatgtcttatgagatcagtctttcttttggaggcaaacattttcggaagttttggaaccatgatgttctatgcctcagacacttgtggtccctgagaagctgctgctggaaaaaggggtccccatccggatcccaggagagggttcttggatcatgccgggaaggaatccaaggcgagtggcagagcgcagtgaaaagagatagtttattgaaagcttctcagttacatagtagggcatcctcagcaagaggaggaatgcctctgttttgtttctttcttatataggggtcttatctatgtaaaagctaagctacgtctccctgcgggtaggctgacaaagtgacatttattactttgttgattgaaagaaagctatccttggcattttagtgcataagtacatcaaagcatgcctataatcatcttaaaagcatatattatgcaatattggggcatctggacattctgttgttgcaagagtttgtctttgcaggtattaagctacttcgtcagctgtaaacatcttatgactgtgggtcatgactggcaaggaatgtgccttgctagttttaagatggaattgattctaaaatggtgtcaccatggctcccctacgctcctgttcccctaaaaaaaccctgccgtaagcggacttaaggatagccttgtcaccctagcaatgtggcagtgaatctctgccaatagcaatctacaaatgttaaaaacttttctttttctggaaaagtactttccatgcattaagtattccagtgcctgttttcctggcactgggctggatgtatatgacataaaatttgcagtattgctccacccccaaactgctctgcattttggccctcctccatctctgatggctttctcttccctgtgctgcagggaactactggagaccacgtgccgcctggccaacacgctgaagaggcatggagtccaccgtggggaccgtgttgccatctacatgcccgtgtccccattggctgtggcagcaatgctggcctgtgccaggatcggagctgtccacacagtcatctttgctggcttcagtgcggagtccttggctgggaggatcaatgatgccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggaaatggccaaggaggaccctgtttgcgccccagagagcatgggcagtgaggacatgctcttcatgctgtacacctcagggagcaccggaatgcccaagggcatcgtccatacccaggcaggctacctgctctatgccgccctgactcacaagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtcggtactgggagacagtagagaggttgaagatcaatcagttctatggtgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaatgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatcagtggccaccggctggggaccgcagagattgaggacgccatcgccgaccaccctgcagtaccagaaagtgctgtcattggctacccccacgacatcaaaggagaagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcctggaatgaaaaggcattgccatctccattcctctgccctcttgagccagcacaggaaggtgaagccctgggatagcgcgcctgctcagataacacaaagctagttagctagtagcaaccgtgttttctccagatctgtctagatacaaaggtcagaaatcttatttttatacttttatattgtggaagaacagcatgcaacactcacatgtagtgtgtggatttacttgaacatgttctttttaacatgtagttatgaaaatctccttttttgcctctactggtgaggaaacatgaggatcagaggccacatttttaattattgttagtgtatttggaagtctgaattggagatgtttgtacctctgtctaaatagttcccttgagaacttccaagcctccggcatcttttcctggtgagtgtttctcctgtgcttggttgtgtataatggagctaactcctaagcggtggggtgaatgtggccgccttagttctgaagctactccagttatgttctgtttcttcaagctgtgatccagaaagatttttgtgcccccagatgcctcttgataggagaggcaacatactccaaatagttgggttcttcagggaagctattagaaactcaggtgacttgttagagcactaacttggtcagagccaaatcctggcaaacgctgcctgaccttcactctgtggttggggcagtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttc

SEQ ID NO: 195 - DNA, 60 bp, Homo sapiens
ggtcccgggcatctgaatgatctgtaggggagggagttcaaataaagctttattttgttc

SEQ ID NO: 196 - DNA, 995 bp, Homo sapiens
agactaccttgtttggcaacaagctgagccgggctgacattcacctggtggaacttctctactacgtggaagagcttgactctagccttatttccagcttccctctgctgaaggccctgaaaaccagaatcagtaacctgcccacagtgaagaagtttctacagcctggcagcccaaggaagcctcccatggatgagaaatctttagaagaatcaaggaagattttcaggttttaataaaccagccatagaggtcaagaacatgcaagaccagtattctaaagttttgcaacaattaagtgctttacctaagtgttgattgtgcctgttgtgaagctaatgaactctttcaaattatatgctaattaaataatacaactcctattcacccacttagttaaaattgatttcttctcattaggatctgatgtgaattcagttttccaatctcctcctagccaacaattttcttggaattacaaattcagtaaaaatggaaactataaattatgtggtctgtttgacttttccaagaattgccctgtaacatacaatttgtcatacaatctattaaaatgccaatgtacaaaatgcacctctgacattttcaggtatgcacaggagaagagttaccatcctggataatggcctaaagacattttcttcttttcctgagcaccgcggccccccccgcgcgctctcgactgtggtagctcgccccctcatgctgcgtgctgcggtgccgtgctcgacccgctcggccctcgaccgccgtctgacacaggaggcggctgtccctgccctgtgtcgccggcgccgggcggcgcctgtcctccgtcgtagcccgcgttggcagcagcgcgggggcgtccatggggtggcgcgcgtttgtctgggtggggcggcggcagcgctgtcgtcgtgcgcgtggggcggggggccgttggcttgcggggttctagtgggcgcggccgtctttgggcgggggcgagccca

SEQ ID NO: 197 - DNA, 60 bp, Homo sapiens
gaggccaagaacttgcaataccaatgttctaaagttttgcaacaataaagtactttacct

SEQ ID NO: 198 - DNA, 6614 bp, Homo sapiens
ctgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagccctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagcaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgtacaaaaaaaaaaaaaa

SEQ ID NO: 199 - DNA, 3018 bp, Homo sapiens
ataaaaccggcccggttctgtggaaagtgggcggcggagccagggtccctggaatggcggagactctgtcaggcctaggtgattctggagcggcgggcgcggcggctctgagctccgcctcgtcagagaccgggacgcggcgcctcagcgacctgcgagtgatcgatctgcgggcggagctgaggaaacggaatgtggactcgagcggcaacaagagcgttttgatggagcggctgaagaaggcaattgaagatgaaggtggtaatcctgacgaaattgaaattacctccgagggaaacaagaaaacatcaaagaggtctagcaaagggcgcaaaccagaagaagagggtgtggaagataacgggctggaggaaaactctggggatggacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctatagaggacaaagaaactataaacaatttagatacttcatcatctgacttcactatattacaggaaattgaagagccatccctggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggttttttttttttgtaataaatgtgtttccgttcacataccctttaaaaaaaaaaaaaaaaaaaaaaaaaaaaaaa

SEQ ID NO: 200 - DNA, 7311 bp, Homo sapiens
gaactcgggttgcgcacttcccggcgctgggaacgcggagcggacgcagtctggccgccattgcgctgcggggaaagcggcctcttgtgtgagggcctgtgggattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaataggaaaaaaaaaaaaaaaaa

SEQ ID NO: 201 - DNA, 3240 bp, Homo sapiens
ggccgttcggagaccagccccagcgtgccaggaccgtttccggggcctggccggggcgttgccgcggggtcggggaccagcacgagtgctgagtcacgccccgcccgggagcgcctcgggtcagtaactcgggaagacgaccaagcgggagcgggagcgggagcgggagccggagcgagagcgcgcgggcgcggccgacagtgcctgatttgagatggggtcccaggtctcggtggaatcgggagctctgcacgtggtgattgtgggtgggggctttggcgggatcgcagcagccagccagctgcaggccctgaacgtccccttcatgctggtggacatgaaggactccttccaccacaatgtggctgctctccgagcctccgtggagacagggttcgccaaaaagacattcatttcttactcggtgactttcaaggacaacttccggcaggggctagtagtggggatagacctgaagaaccagatggtgctgctgcagggtggcgaggccctgcccttctctcatcttatcctggccacgggcagcactgggcccttcccgggcaagtttaatgaggtttccagccagcaggccgctatccaggcctatgaggacatggtgaggcaggtccagcgctcacggttcatcgtggtggtgggaggaggctcggctggagtggagatggcagcagagattaaaacagaatatcctgagaaagaggtcactctcattcactcccaagtggccctggctgacaaggagctcctgccctccgtccggcaggaagtgaaggagatcctcctccggaagggcgtgcagctgctgctgagtgagcgggtgagcaatctggaggagctgcctctcaatgagtatcgagagtacatcaaagtgcagacggacaaaggcacagaggtggccaccaacctggtgattctctgcaccggcatcaagatcaacagctccgcctaccgcaaagcgtttgagagcagactagccagcagtggtgctctgagagtgaacgagcacctccaggtggagggccacagcaacgtctacgccattggtgactgtgccgacgtgaggacgcccaagatggcctatcttgccggcctccacgccaacatcgccgtggccaacatcgtcaactctgtgaagcagcggcctctccaggcctacaagccgggtgcactgacgttcctcctgtccatggggagaaatgacggtgtgggccaaatcagtggcttctatgtgggccggctcatggttcggctgaccaagagccgggacctgttcgtctctacgagctggaaaaccatgaggcagtctccaccttgatggagaggccaggcgggagaactaccgcagcaggtgggcgtacggactgcttggcgcatggcacccgcctggcaagtgctagaactaatgctattcttctggaataagatgccaatgatgtggtggctagaaatgcaacttgtataaaacaaaaatgggagagagagaggtattaaacaaataccccccttagaggatactttctgggtttggaaggtgtgcttgctgtggtactgggtgagcggctcatgtgtgctggctgcatggtgctggggaggccacagccagcccttcctctgcacctgcctcctctgggatgtgcatgtgtgtgtacgtgcttgtggtcatgacgcgtgccatttagagctctcagagcagggcagattgctgggctctggtggccagtgtctgtctgtgagggcaggaaggagagctgcacattgagaacaaaggagggacctgaggtggagagaggcccagcaccccaaatctctgccatcacacggtcggggagcccatacattctgcaacaaccagggacttcacaggagccttgttttcaatttgctaacaggtgcataatccctgtgctccttaagcctcatggccttcctacatttccactttatttgtttgtttgtttatttatttttgagacagtctcgccctgtcacccaggctggagtgcagtggcacgatctcagctcactgcaacctacgccttctgggttcacgtgattctcttgccttagcctcccaagtagctgggactacaggcacgtgccaccatgcctggctaatttttgtattttttaaatagagacggggtttcactgtgttggccaggctggtctcgaacacctgacctcaggtgatccattcgtcttggcctctcgaagtgctgggattccaggcgtgagccactgcggccagcacatttccacttttagatcctactccataccacaggtttcatttaagaagaaagagctagataaatgtgctcttctggttaccccaccctgacagagtgcatttttacacggctagcaggggttgagactgcagcctggcctgccagccattggaggtgtttaaggaagggcagataatgtgactctttgcggggtgccatctgcttacccattagcgagcagagggggtttctgcgggtgacccccagcatatttctaggttacttatgggcagatttgtaagtgacaaaactccagctgatgctgggaatggggagagggcccttgagggactttgtggttttgtgcttctggtttcctggccaaccccagggtcacttgtctggaggcccagctgggcactaatgtctgccaccgactatgttacagtgtataaatgattcctctatttgggagagatcttccaatccagaggagcccctcttggactgcctgggttaaatctgcatagcagaagtggttgatgagttcatctgaagaaattcaggccccacctccccaccctgcccctccctgctcccttttgatggtggcctctgggtactcgggcagagtccttgggacaccagcctctctggggttctcaggccatcccgttggggctgtcgcccaggcctaagtgagtcgtgtgcctctattggaggatggctgttcccctggtggttgcatccaagtatctgtctttctttatggaccacgaagggaagcccaccttcctggaggcaggaccttcggcctaagaaacacaggccctggtgctatctgacctggggtccagcgaggtgggaatcccagtgtgtgagcgacaggccttcttctattgacttacaatattctagaaggacctacgtgtggggacacagttttccaaactgaggaaaatgttgcaataaaagaatatgttgtaag

SEQ ID NO: 202 - DNA, 60 bp, Homo sapiens
ctacgtgtggggacacagttttccaaactgaggaaaatgttgcaataaaagaatatgttg

SEQ ID NO: 203 - DNA, 1270 bp, Homo sapiens
agacgttcgcacacctgggtgccagcgccccagaggtcccgggacagcccgaggcgccgcgcccgccgccccgagctccccaagccttcgagagcggcgcacactcccggtctccactcgctcttccaacacccgctcgttttggcggcagctcgtgtcccagagaccgagttgccccagagaccgagacgccgccgctgcgaaggaccaatgagagccccgctgctaccgccggcgccggtggtgctgtcgctcttgatactcggctcaggccattatgctgctggattggacctcaatgacacctactctgggaagcgtgaaccattttctggggaccacagtgctgatggatttgaggttacctcaagaagtgagatgtcttcagggagtgagatttcccctgtgagtgaaatgccttctagtagtgaaccgtcctcgggagccgactatgactactcagaagagtatgataacgaaccacaaatacctggctatattgtcgatgattcagtcagagttgaacaggtagttaagcccccccaaaacaagacggaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgcaaatatatagagcacctggaagcagtaacatgcaaatgtcagcaagaatatttcggtgaacggtgtggggaaaagtccatgaaaactcacagcatgattgacagtagtttatcaaaaattgcattagcagccatagctgcctttatgtctgctgtgatcctcacagctgttgctgttattacagtccagcttagaagacaatacgtcaggaaatatgaaggagaagctgaggaacgaaagaaacttcgacaagagaatggaaatgtacatgctatagcataactgaagataaaattacaggatatcacattggagtcactgccaagtcatagccataaatgatgagtcggtcctctttccagtggatcataagacaatggaccctttttgttatgatggttttaaactttcaattgtcactttttatgctatttctgtatataaaggtgcacgaaggtaaaaagtattttttcaagttgtaaataatttatttaatatttaatggaagtgtatttattttacagctcattaaacttttttaaccaaacagaaaaaaaaaaaaaaaaaaaaaaaaaaaaaaaaa

SEQ ID NO: 204 - DNA, 60 bp, Homo sapiens
gttgctgttattacagtccagcttagaagacaatacgtcaggaaatatgaaggagaagct

SEQ ID NO: 205 - DNA, 1378 bp, Homo sapiens
cgacgcgggagccgcacgcgccggacgaggctcgctgcgctccctgttgcccagcgcgggcccgttgaggcggagccctcagttcccggccaggacacggtctgggccgccgaatctccggccgaagagcggcggcggcagcggcggaaaaaaatgaagaatgaaattgctgccgttgtcttctttttcacaaggctagttcgaaaacatgataagttgaaaaaagaggcagttgagaggtttgctgagaaattgaccctaatacttcaagaaaaatataaaaatcactggtatccagaaaaaccatcgaaaggacaggcctacagatgtattcgtgtcaataaatttcagagagttgatcctgatgtcctgaaagcctgtgaaaacagctgcatcttgtatagtgacctgggcttgccaaaggagctcactctctgggtggacccatgtgaggtgtgctgtcggtatggagagaaaaacaatgcattcattgttgccagctttgaaaataaagatgagaacaaggatgagatctccaggaaagttaccagggcccttgataaggttacctctgattatcattcaggatcctcttcttcagatgaagaaacaagtaaggaaatggaagtgaaacccagttcggtgactgcagccgcaagtcctgtgtaccagatttcagaacttatatttccacctcttccaatgtggcaccctttgcccagaaaaaagccaggaatgtatcgagggaatggccatcagaatcactatcctcctcctgttccatttggttatccaaatcagggaagaaaaaataaaccatatcgcccaattccagtgacatgggtacctcctcctggaatgcattgtgaccggaatcactggattaatcctcacatgttagcacctcactaacttcgtttttgattgtgttggtgtcatgttgagaaaaaggtagaataaaccttactacacattaaaagttaaaagttcttactaatagtagtgaagttagatgggccaaaccatcaaacttatttttatagaagttattgagaataatctttcttaaaaaatatatgcactttagatattgatatagtttgagaaattttattaaagttagtcaagtgcctaagtttttaatattggacttgagtatttatatattgtgcatcaactctgttggatacgagaacactgtagaagtggacgatttgttctagcacctttgagaatttactttatggagcgtatgtaagttatttatatacaaggaaatctattttatgtcgttgtttaagagaattgtgtgaaatcatgtagttgcaaataaaaaatagtttgaggcatgaaaaaaaaaaaaaaaaaaaaaaaaaaa

SEQ ID NO: 206 - DNA, 60 bp, Homo sapiens
attggacttgagtatttatatattgtgcatcaactctgttggatacgagaacactgtaga

SEQ ID NO: 207 - DNA, 3830 bp, Homo sapiens
ccagtgcaggacgcgctgacagctcgagtgagcggactgcccaggacttcggaactagacgagttctgtagaaatcctgtcaaagaatatgaagaaaaacagagaaagattctgcaatagagagagagaatttgtatataaatttaaagtaggaagtcagtgcttagaactgagagtgccactcaaatttcctgttcaagagaatgccagtcatttgcatggacgtctgatgctgctgcacagtttaccgtgctttatagaaaaagacttaaaagaagctctgactcagtttatagaagaagaatccctcagcgattatgatagagatgctgaagcatccctggcagctgtgaaatcaggtgaagtagatttacatcagctggcgagtacatgggccaaagcttatgctgagaccacgttagagcatgcaaggcctgaagaacccagctgggatgaagattttgcagatgtgtaccatgacttaattcattctcctgcctctgaaactctcttaaatttggaacataattactttgttagtatctcagaactgattggtgaaagagatgtggagctgaaaaaattacgagagagacaaggtattgaaatggaaaaagtcatgcaggaattgggaaaatcactgacagatcaagatgtaaattcactggctgctcagcattttgaatcccagcaagacctagaaaataaatggtcgaatgaattaaaacaatcaactgccatccaaaaacaagagtatcaagaatgggtaataaaacttcaccaagacctaaaaaaccccaacaacagctcccttagtgaggaaattaaagttcagccaagtcagttcagagaatctgtagaagcaattggaaggatttatgaggaacagagaaagttagaagaaagttttaccattcacttaggagcccagttgaagaccatgcataatttgagattgctgagagcagatatgctggacttctgtaagcataaaagaaatcatcgaagtggtgtgaaacttcatcggctccaaacagctctgtcactttattctacatctctctgtggcctggttttactagtagataatcgaattaattcatatagtggtattaaaagagattttgccacagtttgccaagaatgcactgacttccatttcccccgaattgaagagcaattagaagttgtccaacaggtggtactttatgctagaacccagcgcaggagtaaattgaaagaatcacttgattctggaaaccaaaatggaggaaatgatgataagactaagaatgctgagaggaactatttaaatgttttacctggggaattttatattacacggcattctaatctctcagaaatccatgttgctttccatctctgtgtggatgaccatgtgaaatcgggaaacatcactgctcgtgatcctgccattatgggactccgaaatatactcaaagtttgctgtacccatgacatcacaacaataagcattcctctcttgctggtacatgatatgtcagaggaaatgactataccctggtgcttaaggagagcggaacttgtgttcaagtgtgtcaaaggtttcatgatggaaatggcttcatgggatggaggaatttctaggacagtgcaatttctagtaccacagagtatttctgaagaaatgttttatcaacttagtaacatgcttccccagatcttccgagtatcatcaacactcactctgacatccaagcactaaacccttatagattgacatgctggcagaagatgattgttaaactctccaggaacttgtgctatgctgggaatctgtcaagcaaaagatgcccagaaagagaacttgcagctcaatccacaaatcaagatacatgtgtgtgaaaccattccaaaaatttatatactgcacaaactggtgatcaacccctaacttaaacacttaaagtctctttatgaatttctctttttttcttctctgtgttacctgtgaatattagtaatctaaaactttttatttatcacacatggacacttgggaaaggaaacttgattatatttacatggaggcatttgactttttcaagaggcttgactcgtctcaggtgcaatccttaattaaacatacaaacaaaattttccttttactttctttgccaaaacaaaatgtaaaagcactgaaatatacattgcaagtacaaatttcctgtgaaaatctttttatagaaacacaaatgtataagacaaatgtgcttgttcttttaaattctcctgtttcagaatctctttttaatctactcctaaggatgtacaagttagagtcagaagacgttttagattttttccctctctctcatcctcccgctgtgcccttgcacttgcatattaataacatttcatggactgggaaatagtgttcttttttgcaagcttgatgtcaagttagtctaaaccagcacctggcagtattttagtgctcatcaacattgtgacaatcacacaaggaagatcatttctacatttctgtcctccctgcgttctcagcttgcttaaccattcctctacctcttgcatttttttgcggataaatgtatccccatttctgcttctctgtttcccctccttttccattgtttttccttatggtactactttctcaggtgctacatatcatatatttgtcccatctataacatatttaaatgctataagtagtaactccattaaacaaaggcatttacaaaagcacacaggtgtttagaaaagcaatagtttcatcaattccaagttatgtggatattgtaactggccacaagaatgaaatggagggcatttggtgtcataagatggcatgtcttgatgacaagaaacaaaacgcccttcattaatatgcctcagtgtaataactattatagaaactgttggcaagcagagtgctttcctataacagaatgtgtcttaattttctactcgagggaaaggtttgtccaggtaacaacactaaagacaaccctaagaacacccactccagcagtatgtccattagacactaaaactctccaaattatttgtcagggagcctggcgattctgccaagaaggcaggtgttttgcccttagagcctatacagttctcttggagaaattgtctttcaggcaccactgttaatcactgagactgattctaatgcaaagcagggaagacagaggcagaaaccaggagagtggtagatcagtgcagcccagatatcggaatggaggagcaaagtttcattcacggatgtttgttgaatgctgctgcccaactcttcctttgtcacctctaggctattccactaagttacttataaactggtggctttaactgagggctgtgtaaaggtactatttggcatgtgaagtcaggataaatttatcgaatgtccgttttccacatgcaactgtgttacagaagtagtaaaattggaagaatcatgtttatggtgttaccactgatggaaacacacaaacaccaagctaataataaatatataacttaaaaagctaattatatgcactgaaatggtgggaattttagtgatgcagtaattgaggagtctggagttttgtatttggaccaagaattatgagatgaggatctttttctgagtgttctaaagggcttcttgagggggagtggtttaaagcacttcatgaatgatgtgaagaaggtaccttgggctgagacagcattctaggtacagatggcactctgttcaaccaactgtggatggaaaatattctgaaaaaaaatacaataaaaattttaaaaatacaaaaaaaaaaaaa

SEQ ID NO: 208 - DNA, 60 bp, Homo sapiens
ttctagtaccacagagtatttctgaagaaatgttttatcaacttagtaacatgcttcccc

SEQ ID NO: 209 - DNA, 818 bp, Homo sapiens
ccacgcgtccggcggggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaatataataatttaaataaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 210 - DNA, 60 bp, Homo sapiens
ctgggttgatacctgaaagaatcctgtcttatttggtctccataatcctttgaatggaaa

SEQ ID NO: 211 - DNA, 4252 bp, Homo sapiens
aactacgagtcccgacgtgccgcgcgcggcatgcagaagcttcactgagcgggcactggaggtcgcgagcacgttgctagtgggcgcggctggcggggccgggggcggcagggggctagcgtccggctgagcccggcgggttcctgcacgcggacccacgctttgtcgggctgctctgctgagtgacaccgccgtggcatccgaggagctgtggtccagcctgcgcggcgggaagcggcggcggcggctccagcgtcctaagagaagctgaaacctatcaacactcttcaaaatgcaatggaatgtaccacggactgtatctcgactggcacgcaggacatgcttggaaccacataatgctggtctctttggacactgtcaaaatgtaaagggacctttacttttatacaatgctgaatccaaagtggttttggtacaaggccctcaaaaacaatggttgcatttatctgctgcccagtgtgttgcaaaggaaaggaggccattggatgctcatccaccccaaccaggagtccttcgccataagcaagggaagcaacatgtttcattcaggagggttttttcatccagtgccacagctcagggaactccggaaaaaaaggaagagcctgatcctttgcaagacaaatctattagtctttatcaacgattcaagaagacatttagacagtatggaaaagttctgattccagtgcatctaataacttctggtgtttggtttggaacattttattatgcagccttgaaaggagtgaatgtcgttccttttctagaactcattgggttacctgacagtgtggtaagcatcctgaaaaactcccagagtggaaatgccctcacagcatatgccttgtttaagattgcaacacctgctcggtataccgtgactttgggaggaacatctgtcactgtgaagtatctgcgcagtcatggctacatgtccacgccgccacccgtcaaggagtatctgcaggacaggatggaagagacaaaggagcttatcacagagaaaatggaagaaacaaaagatagactcactgaaaagttacaagaaaccaaagaaaaagtttcctttaagaaaaaagtggaataaggtgccttatatagcagtatagaaaattcctgcactttaaccctttggaaactatgggcaaagatacatgtgtctgattatttttttggttagttgccgaaatatactagttctctgagggttaaagaagtaaaatacctttttaaagttaaatatcactagaaaaatcagtgttattacaagggaagaaatgaacccagtttaagaatttgccatcagtagcagtattaagcagtggttaatgtcttagaagtcagacttctttttcaaggtcttcagaaccacacttgatttctgttttgttgcagctgtaattgacacatactaggcagctgactccttgaatatccagtgtgacccataaaatagtctgttaataccggatcttaatttttatgttattcattaagattttaactatattcagtacgtaatttggagacaaactagcatcatcaaaactgcctgtaaataaggtgtttagtctttctataaaaacagaatagagcagttacctaccagttaaaatatcttatatgaagaaaatagaataaagatccagtcatatatgtaaataagatgtactgattgtacgtaaatgaaaaatggaccctttaaaaattatttttacctgaagcttgtcataatttttttaaagcaaatatatatatggtgatggtacttttcaaagtgtgtattagtggtgatcacctcaaacataaacctctgttgtgaatcatttgtgtccttttcaactgtctttcagaggaaaggtaaaaaatcattaaaccttaaattcattgttaaaatcaaatatttgtcagcagtaactcaagctcatggttctcaagcagaaaaaggtttgggagactaaaaatggagtcaggttttcatggagactgctaactccttggggtagacatgggccttgcctcagcaaaccagtgcaatttcccaatgtcttagtttcagaattcatgctgatttcattatggagtaaagttttaaattgtggctgctgctttttgtcttacattgaagggaaatatccttgtttgagcattctacttgattttttttttttttttttttttttttgagacggagcctccctctctctctcccagactggagtgcaatggtacaatctcggctcactgcatcctctgcctcccaggttcaagtgatcctcccgcctcagctttccaagtagctgggagtataagcgtgtgccaccacactcagctaatttttgtatttttagtggaggtggagtttcaccatgttagccaggctagtctccaactcctgacctcagcctcccgagtagctgggactacaggcgcccaccaccacgcccagctaatttttttgtatttttagtagagatggggtttcaccatcttaacaaagctatcattaaatcatttgcttgtaatgaaattcagccgttgtcagctgtgagcgttgcggggctggtggggtgtgtttgagtatgtaagtgtctatttcctgtgctctaacagtgactatttcagttctaacccttcaattgctaattggatgagggaatggcctcttagattgtccttgttttgacttatctgctaaggcgagagaatgtctgggtttgccacacagtcccgcagggacccctgctctttgccaggatttttatatcaagtacttagtttggccaaatttagagtatagtttaaaggggaaaaaaagtttgtatttgatgagtctaattactatattagaatgctttttaaatgaatatgctgtgattggaatctcttcttgggggccggggagagtgctgagagatgcagctgtgtctctgctctctgcagtcttgggcaggcagcaccgctgtctcctgatacagagggttgaatgcactgcttcacattgatgccacattttcaaatctaaacatgattaacatgttttttaagtatttatcaaataattcacatttttgcaggtttaagtgctgttttttaagatattaaacatgttccttgtttcttttttctttttaaccactggagactatgtgaaaatcttgtgttatatggaatttttctaaaacaatttccttttacttttcatgttgcatattttccagtggggataaattggaggttcttattactaataatcctgaaactaaaatttgcttttcctgcatagacatcttttgttagtccatttgagttttgttgccatccagtttcatgatcatgttgtgttagtctaatagacaatgagttactgcttgaatgatatgaaattctctagtaaaaaatgctctgaagatgtgagaagctctgttgtattacttggcaccaggaatgttacaaaaatgttgttgctagcatattgctaacctagtccttaagtttcagggattcctgtaatatgttgagtttggagtattaatagcaggctaacagaatacagtaccaatatgccaagttaaataattgagaatatatacagtatagtttgctatgtataatagacctcatttcatttacagtacacctcacacttgggattaattcacctataacctctgtgaactgcgagtgctcggcagaagcagccctgtgtcttacatgtctacatttatatttatatttatatttatttttttgagacagagtctcactctgtcacccaggctagagtgcagtggcatgatcatagctcacttgcgtcttgaactcctggctcaagtgatcctcccacctcagcctgctgagtagctgggactacaggtgcacaccaccatgcctggctaaaggcatgtctgcatttatgcgaggtgtgttgaccgggtggggagggagctaggactgagattcgcctgtgtaaaatgcacaaaaagggtttgctaagcaaattgatatttgaaatgaaagatggattaggtgagagacttagtttattcaggaataagagcaaaaccaaccacatcaaaaaatgtatttcactgagacagccttttgtacatacagcagggtgctgtttacagatttcaagaaaggagaaaaagaatgcttatactgagattacctacctcccagtagtgaaaataataaatttatcccttgaaatataaaaaaaaaa

SEQ ID NO: 212 - DNA, 60 bp, Homo sapiens
gatggtacttttcaaagtgtgtattagtggtgatcacctcaaacataaacctctgttgtg

SEQ ID NO: 213 - DNA, 2061 bp, Homo sapiens
atgaggcggacaggccccgaggaggaggcctgcggcgtgtggctggacgcggcggcgctgaagaggcggaaagtgcagacacatttaatcaaaccaggcaccaaaatgctaacactccttcctggagaaagaaaggctaatatttattttactcaaagaagagctccatctacaggcattcaccagagaagcattgcttccttcttcaccttgcagccaggaaagacaaatggcagtgaccagaagagtgtttcatctcatacagaaagtcagatcaacaaagagtccaagaaaaatgcgacccagctagaccatttgatcccaggcttagcacacgattgcatggcatcccctttagccacttcaaccactgcggacatccaggaagctggactctctcctcagtccctccagacttctggccaccacagaatgaaaaccccattttcaactgagctatctttgctccagcctgatactccagactgtgctggagatagtcataccccactggctttttccttcaccgaggacttggaaagttcttgtttgctagaccgaaaggaagaaaaaggggattctgccaggaaatgggaatggcttcatgagtctaagaagaactatcagagtatggagaaacacaccaaactacctggggacaaatgctgtcagcccttaggcaagactaaattggaaagaaaggtgtctgccaaagaaaacaggcaggcccctgtcctccttcaaacatacagggaatcctggaatggagaaaacatagaatcggtgaaacaaagccgtagtccagtttctgtgttttcctgggacaatgaaaagaatgacaaggactcctggagtcaacttttcactgaagattctcaaggccagcgggtcattgcccacaacactagagctccttttcaagatgtaaccaataactggaattgggacttagggccgtttcctaacagtccttgggctcagtgccaggaggatgggccaactcaaaatctgaagcctgatttgctctttacccaggactctgaaggtaatcaagttatcagacaccaattctaaatgtttgaagctttgtttctaaaagtaccttgaaatgatagagatgtaggaaaatatagttgtgggtggagagaggagtgagtttgtttaggtgggaaggtggcatgggatgaagttgtcattactgagcatcttctctgtgtaaataaagggcagtaccattgttaagacagtgggattggcatcatggctttccctcaggaaggtggtggctggtaaattccctgaatgagtctatgatgaacactgaggcagcacagtgggtatttatctctatgaaagtgccttttactcagcctgcacagagccatctctttgcccttccagatgtctgactgggaccttgcttatggatgtgtttttttttttttttttttgagatggagtctcgctctgtcgccaggctggagtgcagtggtgcgacctcagctcactgcaccctctgtgtcccggattcaagcgattctcctgcctcagcctcccgaatagcagggactacaggcatgcgccaccacgcccagctaattttttttggatttttagtagagacgaggtttcaccatattagccaggatggtctccatctcctgacctcctgatccgcccacctcagcctcccaaagtgctgagattacaggcataagccaccgcgcccagccagatgtgtgagcttttaatctctggctgatcttaacccacatcagcctaagcttgggatgattactcttgacccttttttttcagtgattagcaaatctccccacaacccaggtgtggagagaagagaggtagaatggtgctagtttcctattttatttttgtggtaactgtacagcactttaaagttatatactctatgtttaaatatctcccttaaaaagcctgagctgtacaacaatctggatgtgactctgttacccttttcccacaagataggagggaatcccctttgtaaaactatgaatccaaataaatgtttacaaagtg

SEQ ID NO: 214 - DNA, 60 bp, Homo sapiens
gaggtagaatggtgctagtttcctattttatttttgtggtaactgtacagcactttaaag

SEQ ID NO: 215 - DNA, 1091 bp, Homo sapiens
cgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaaaaaaaaa

SEQ ID NO: 216 - DNA, 60 bp, Homo sapiens
aatttatccatcaccaaccatttcttcttggataccatcaagtaacagctattatttgcc

SEQ ID NO: 217 - DNA, 3641 bp, Homo sapiens
gagtcaccgcagtggctgagctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccacccgccgggctcctggggccgccgccccgcgcggtcctgtcggcgtccgcggccgcgcccggcccctggcccgctcgcccgccggcaccatgatggaggagatcgaccggttccaggtgcccaccgcgcactcggagatgcagccgctggacccagccgccgcctccatctctgacggagactgtgacgcccgggaggagaagcagcgggagctggcccggaagggctccctgaagaatggcagcatgggtagccctgtcaaccagcaacccaagaagaacaatgtcatggcccgaacaaggctggtcgtccccaataaaggctactcctcacttgaccagagccctgatgagaagccactggtagcccttgacacggacagcgatgatgactttgacatgtctagatactcctcctccggctactcctctgctgagcagatcaaccaagatttgaacatccagctgctgaaggacggctaccggttagatgagatccccgacgacgaggacctagacctcatcccccccaagtccgtgaaccccacgtgcatgtgctgccaggccacgtcctccaccgcctgccacattcagtagcgggcggggccactgcggtcgccggggcggggccgccaagggccgggtaggacgggcagaggccgaccccttcccagctcgtctgcctgcccccggccccgcgcccctacagccgccaacctcgtataacagtcattgcttcctcctatggtaggacgtgtacctctgtgtgttcatggagctggagaaaccaaaactgggtctctctccacccgggagctgaggaggggtgggggccgtttgttcagttacctgggggaacctcacccagcaccctgccccgcttcccagggctggccaagagagaagactggacggcagggaggtcaacattaacgagtggggggatcacaaagccaggggcttggccccaccccagcgaagccatgaactcccaagccccggcctcagcctaaccaggaaaggggctcggagggagaaaggcccagggcagtggggacgggtcccagcacctcggagcccccttcacacgccccctaccggcccatgtttctatttgcatttccccctcctcagatgggaagcctggcaaagctgcccaaccgggtagtgcccctcacccatcggatcactgccttcttcctcctcttgccccattcacccgcttccttgcactctgggagtggggcagggtaaggtgggccttacagacaggctgaggtttgggtggtgtgatctgtcctaattggcccctcaccaatgcatctatctgtctgccaccagcccaccccaccctgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaactgccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaagccaaaaaaaaaaaaaaaaaaaaaaaaaaaaaaaaaaaaaaaaaaaaaaaa

SEQ ID NO: 218 - DNA, 60 bp, Homo sapiens
gcagtattgaccatcatccttggttgtgtatcgtgtaacacaaataatgatattaaaagc

SEQ ID NO: 219 - DNA, 3750 bp, Homo sapiens
ggcggcgcgcgcggccccggcgagcaggggaagccggtggccgcggctgcggaacgggcggaggctgccggtttcgtaaccgtcgctcctcctcgctgactcgcgggctgtgaggcctgggtcggctcgggccgcaccgcgcggggccgctcggagtggaggccgcctgggggcaggcgggctagaggagcaggtacatgtgaagattttttggcagcttagcgtggaaaccattgatcaccctgctctcatttctacctgttctgtgttggcaagggagagtgcccaaatgagcaagatatcgcagcaaaacagcactccaggggtgaacggaattagtgttatccatacccaggcacatgccagcggcttacagcaggttcctcagctggtgcctgctggccctgggggaggaggcaaagctgtggctcccagcaagcagagcaaaaagagttcgcccatggatcgaaacagtgacgagtatcggcaacgccgagagaggaacaacatggctgtgaaaaagagccggttgaaaagcaagcagaaagcacaagacacactgcagagagtcaatcagctcaaagaagagaatgaacggttggaagcaaaaatcaaattgctgaccaaggaattaagtgtactcaaagatttgtttcttgagcatgcacacaaccttgcagacaacgtacagtccattagcactgaaaatacgacagcagatggcgacaatgcaggacagtagacctcaccctttccagactttagagcttgtggcttgaatgttaaaggtgtgaccaccgacaccactcatgtcaatggctgaaagttgtccatttccatgactcaaagacccattggaggctattttctgggatcagcactgaagagttgattagctaaaaatgttagccttgtaattcgaatatctggttttaaatgatagaggtttttgtgggaatcaaaatcccccaaatgttaaggtatatggtaaaaaaagaaatatctgggatcccgatgttcttaataaatcctgacttcccaagaaatgcttcttttttaagttgacaaaaggaatggggaactggcaggccgcgcagaaggttcttggttttaatggataggctgaattggattaagaaaagttgaatgccacctatggtaatctatttgtgattttcttctaaattatgtattataaattcgtagagctatagaaagcaatgagtgtgtaatttggagtgattttatatatggcataaactttgttttaacataattagtactgttttcccccaaaagtacaagtttttgagtagcaatgtcaggttaagtaaagaaacttcatcacatcttataggtagtgtgtggccaattgacttaaaaaatacaaataacatttaggaagcaaatagattaaacacaaaaataaaactaaagcataggaattatgtttttgagatacctttgggcttagattggcattgttttattctaaaaacccaactcagtggtgtagagaaacttgtgtaccaaaattttagtttctgcagatgctagtgtttttttggatacaattttgacaaccaagttagtaaacaaaatatcttaacagtttgatgacacaagctactgatgagggtttggaatattaattcagaaggtagtttctcttgtgttcaaaatagctgccatggggctgttacttttaaagtcaaaattttcttctgaaggctcattttggtatttgatcttaaccaagtgattattagagaaatgtatcaactccatgccatctcccaaaataattgtctaagaaaacttgaaagtgtaaggttttaacctttaatttatttctcttaaatacatcttttgatattgttgttgtgacatttctttttctggttagtgggctttccagactttgtaccactgcttctgtttattcatttatatgcttttgtgtcccataaattatttcagaaaatgctgataaaactcaggatattgacatttttgttgagactaaaaaatggcagtcgctaaagtagggactctagagtctggcttacgtcagtgttggtagtttagattgtctttgtcaacgttttttcttctctcttttgctttcttttctttctctttttttcttagcacagttctagctcaaatttgtgtattttttgtgtgcctgggctggagatgagagactgagtcataactgatttaaaagtttgtgttatcaggtatcttatttgaacatggtcatttttggccacattgctgtttcatactaggacttgggatgatgtagccagaataaaactcaagttgcaccctccggttggtggaagattgctgaccgtgccgtttctgggcaggagaagacatcatggtgtccagcaactcagcaaagccattcttaagagtcgtgaggtccttctgaatgtaaaactggagcccaggagaagctgtcccaggagggctgttaactccctatagagccaggagacaggataggggtttctagggtccaacaccagcttaccttggagtatgaatctacccatgaaggatgagagatgttttgaaaaactagccaggacacacccacaggatcctactggctccttagcagctgattggtgttacataattaacttaattggagatgcattaggtcacttgaatgtataagcaagcacctatggtaggcgctacagacatttaaatctcttgggaattcgatgctcccatggaatttataccagttatatgaattgacttaagtatcttgaaaaagaaactttagagaaagcatcaggggtgtgtactcagtatttcaaatcagaacacaagattggaacttttggaaaaatgggttcaagctttcctattagccatggaaatgcaaagtttagcagaagcaagcaattaggcagagaacaaaaatgttaagcatggtgttgtctatcttattgaagtggttggaaatgaaagcttttaatttgatagatttatcagtataaaattagggaaaccacgtgtggggaatgaatcaatttagagcttcgggaattgtgaggtgacttttgtaacttttgttctgtgtgtgacctgtgaaccactaggatgtgatctgcccttgtgggcaggtccagcatagttaggagttaggctttagcataaatttctagctgcatctgagtctcctgggatgggtgctctttggctggttttggctgcggatggtgagatcagagcagctcttcctgctgctggcccctgcaatcagttgttgggatgccagtgcagatcactaagtagtaagattttaatcaaacacgaccaggtccgaaatgcaggtcatgagtgtgaaattctcaaatttacataaaaagtagaagtatagacagtttaacatttggtattaaaggagaggaaattgtagcagcttttcacgtttcccagtccccattagagggcttgagaccttgtacctgaacaacccattttgcactcagtgctttctgatgccttaggagaattgttttgtttcacaaaagctgggaaggaagaagtccattctgcagctgttagatctgcctctcaggaaaaagtactaacttgttctttttgttcctggctttcatcagtttgtgagatttctctattttttttaaatataattttatttctttcaacaaatataaaataaaaaacaactttggaacaatgaaaaaaaaaaaaaaa

SEQ ID NO: 220 - DNA, 60 bp, Homo sapiens
ggttttaaatgatagaggtttttgtgggaatcaaaatcccccaaatgttaaggtatatgg

SEQ ID NO: 221 - DNA, 3828 bp, Homo sapiens
cagtgccaggctggaggcggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtacccttttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcacagacctctgctgtagctttaatgcatacaaacatgtccctccgcacaactaacctgccctgcctctccatctctcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattacaaaaaaaaaaaaaaaaa

SEQ ID NO: 222 - DNA, 60 bp, Homo sapiens
tttgatgactgtacaacaggaagacttgaaaaatcacgtggattcatattaccaccgctc

SEQ ID NO: 223 - DNA, 1750 bp, Homo sapiens
gatgcctgatctcatcaatctagcgggagagacaggataacctgtccgagagtatagcgccacttatgactccgccggaaaaattactttaaaaatcgccaaaaattacttggagcaaagggcagtccggcggcgttcgccaaggtggcgcagtcggttttgacctgtagcagagaaccaattctggagaacagcctcacttctttgattgaatacttacataatgcattggaacatgacatgagattaaggtttaataatgatagaatgaagaccacaataaaagagaccacaatccttagctcagcaattcttacctttcttacctatttgatgaagatgtcttttgaaaggtgtactgcaaggaacaaaatgtttgtaaattctcccttttacccaagggtggataattactgtacctcctcatggaaaaagttttatttaaagtgttatttctcattgaatactatcaaaaaggaaaaaaaaatgacctaaacttttgagatagatttggctctagtaagtatttagttatatcacttgcatatctgggagaagaaataagagactatcatcagtacattcccatctactaaaaaaatttattttacacatgtcaagggattacttataacttccattttattactaatagcttgaacccttttaatgaagacctaactcctccaccagaaatttaagtttatgttcttactttgtttacttataaaatacatctcaggtatttcggatgtcttttttttttctaagcctatatgaaatgaaaaatatattggcaaagtaaatgtttaaaccttttacgttaaaattactttgaaagatgaaaagttagtgctgtttttgtcacgttatactgaaattaaatgtttataatttatattttgggtttatgtataaatcatggaatttatgcaaaaatatgagtagtacagattctcctctaattctgtaggactttgaataatgtgatatttttcttataattggacccttgtgttttgaagaaatgccaactgcttgaagaatctccttgttatttgtattatttgctatagggttagatgttgagaaattctgctgacaaaaaattttaagccagttttacactaaatgttcctcagtctgattaatttgttattggatgtattctgtatctttcttttgtaatttgtgacttttatccacttagcacgaatgattctattaaagaaaatcattaggaagtggtagaaactttaaatcgccccagagtttgcctgtttccatattttattatcttataatcttcgggagtgcttacacttatggagctaacattttcagagatacagcttcttatagtaacactaaaactttcttcctctttggactgaatacctataattataactatatggtagtttaagtttccttgtgattagtcaaaaataccattttagtatgaagcaatgaagtctattatttgttgtcccataattgagaaagcttaaatacaccttttatgtaagagtttagtaagattctagcttagtctacacagatttttatatcaatttgtttatatttttattaatgtcatttctggaagtgtgaaaatgttaatgttcaacaagcaacattaaaaatagatttgaaacatttatatatagagaggtacacatttatttactgtttaggtactgaagattatcacttaataaaaaatatatatcccaaaaaaaaaaaaaaa

SEQ ID NO: 224 - DNA, 60 bp, Homo sapiens
tacacatttatttactgtttaggtactgaagattatcacttaataaaaaatatatatccc

SEQ ID NO: 225 - DNA, 549 bp, Homo sapiens
ccttcggccacccccgctgaccatggcagtgtttcatgacgaggtggaaatcgaggacttccaatatgacgaggactcggagacgtatttctatccctgcccatgtggagataacttctccatcaccaaggaagatttggagaatggggaagacgtggcaacgtgtcctagctgctctctcattataaaagtgatttatgacaaagatcagtttgtgtgtggagaaacagtcccagccccttcagccaacaaagaattagttaaatgctgaagaagccttcaggaatccaaatcctgaacatttggaatgagcccagatagaaatatcgaatgcaaagctactggcttcacagagacaaccatttatgatttgctgttctgtaagagtgtggattctttctatcaactgctgatatcatcttcaggaagcaagtccataacatgacatatctggattttgtgcttagaaccttaaattggaagcattcttaattatgcatctaaatttaaaagaagataatttcaaaacagtaaaaaaaaaaaaaaaaa

SEQ ID NO: 226 - DNA, 60 bp, Homo sapiens
gaagatttggagaatggggaagacgtggcaacgtgtcctagctgctctctcattataaaa

SEQ ID NO: 227 - DNA, 5809 bp, Homo sapiens
ccagccaatgggcagtgaggcctgacgcggggggcggacgctggggccgagggtagcttgagcgcggcggcggcgttgttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgcaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggctttatttgctagtcttgtctgtgaactgagcatctgcctcagttttattacttgaaatcttggcaggtgcttaatagggaacatacatacagctatgtaactgtgaataattgtatatatctctagttaagaatgagggaatggggaggtttgctttctaaacaagtgcattctgaaattgacttaaaaatttttagtgtgggtcctaaagtttagagatgggcaaggaggtctctaatccaccgcttcccgcttgagaagggaggggtatcaaaattgagccccaagctgtttgttccagtgtaccaagcactgactttatgcctttggcctggagatggcagaagtgaaagctggccatctgcaaaaagcagataagtgagtttgaaccttttgcattttgttagctcagtcagtcctcatcgtggtcctgaggcataggtactgttgtaccaaggtcacttatctaacaaaataacccttcatgtattttaaatttatttgacaagtctgcagacaatccttatctaaccagctattttcttaattgctacagcttgacctaccagtattccggagtaaccagcaaatgcaaagttaaccttgttcctgcatcatctttttgatggttcaaatttcagcctccctgactactacaaagccagagcagtcttagtaccagaaacagtgttgcactttcgttgcatgtgctgtgtgaccccaaggggacagggagtcactttggtcatctctgtccccagtacagatcttgattcatagtgacattccataagtggggtgacagcaaatgacttgcaggtagtctcattgtaggtttgtgcaccagagtgaccctgtgagcctttgttaataggttgggagctcagggtgtttatgtccacctgtctggtctagccaaacagtttttttctgggaatcaaatttctgtggtttttatggccagaaattttaaggacttgtgtgtgctgggatatgagaatagaagctacagagttcttttcttgggacctagactgggaggtgcaatgtcaggacctccaggtgaatggtaggatctgagttgaccctgcagttcggttatgcagtcaattatttctttttaagaggaggaggattcacttgggtgttgggatcaaatttggattctgtcccaggccttactgtaaaactaggggattgcctttccatatctgctgggggtggagacccttatgtgcagcactcaatcccactggaagcctaatgctgcagtcagaagcaatgcctggctggggcagtaggggaaattccacccaattttgctatgagcctaaaacctctttaaaaacggtcagttaactaaaaaataaaaatcaagtctttaggagagtagaaaacacaattaactaaaaagcagggacatctgaaagagacgtattaagttaacatttttaaaaatccaaatgaaagtaaatggaataaatgtatcaggtaaaggacaagttgtaagcttggatttttaggtctagcaatacactgtttacaagagcatcacctaaaatgtgacaaaagatgttgaaaggatgaaaaaaggtatagtagacatacactaaccaaaaatgtagctctttgaatctcagaaaaaagtagattttaataaagtgtgaaagttgtcaatcaaaaaaaaaaaaaaaaaaaaa

SEQ ID NO: 228 - DNA, 60 bp, Homo sapiens
acatcatgctacactttacactaaaaatctattactgtgagtgtgaaaaactagtggtgg

SEQ ID NO: 229 - DNA, 2423 bp, Homo sapiens
acccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgc

SEQ ID NO: 230 - DNA, 60 bp, Homo sapiens
cataactcaatggcctaaaactggcctgacttgggggaacgatgtgtctgtatttcatgt

SEQ ID NO: 231 - DNA, 1602 bp, Homo sapiens
ggcttaggctgagccgtggccgccacagcccatcgtaatgccgcatggtgcttggcactccagagagccaataggaatgaaagaattcatttgaatcggccaatgccggcgggttagggggcgggggttgaaaaccctataaaggcgtcgatcggccggacaggcggcagcggcggctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 232 - DNA, 60 bp, Homo sapiens
tgaaccaacagaacaacctgtgaggaagaacaaaatggcctctaatatctttgggacacc

SEQ ID NO: 233 - DNA, 3366 bp, Homo sapiens
gcatgcgtaggcgcgcggccgcggcggcggctggggagggttcttccggaaggttcgggaggcttctggaaaaagcgccgcgcgctgggcgggcccgtcgctatataaggcaggcgcgggggtggcgcgtcagttgcttcagcgtcccggtgtggctgtgccgttggtcctgtgcggtcacttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaagatattgtgtgacagtgtcttatttagggggaaaggggagtatctggatgacagttagtgccaaaatgtaaaacatgaggcgctagcaggagatggttaaacactagctgctccaagggttgacatggtcttcccagcatgtactcagcaggtgtggggtggagcacacgtaggcacagaaaacaggaatgcagacaacatgcatcccctgcgtccatgagttacatgtgttctcttagtgtccacgttgttttgatgttattcatggaataccttctgtgttaaatacagtcacttaattccttggccttaaaa

SEQ ID NO: 234 - DNA, 60 bp, Homo sapiens
gacgatattactaatgaggagtacggagaattctataagagcttgaccaatgactgggaa

SEQ ID NO: 235 - DNA, 3284 bp, Homo sapiens
gccggttggaggcggccgaaccgcagtagggaaagacccaggctgcgggacgcggtgcaggctgcggcgctgacggcctctgctccttccgcgggtttccgactccctgccctagattttctgcttagcgacttggggtcccctctcgtttgcttctggtaggagtcgcaatcccagcagcaatagcccagaagaggacacggttcccgtaccgaagggttcagtaccagcagcccgaccatcacgcggcgggatgtctgtggttggcattgacctcggctttctcaactgctacattgctgtcgcgagaagtggcggcatcgagaccatcgccaatgagtacagcgacaggtgtaccccggcctgtatatcattgggatcaagaactcgagccattggaaatgcagcaaagagccagatagtcacgaacgtaagaaatacaattcatggcttcaaaaagcttcatgggcgatcatttgatgatcccattgtgcaaactgaaaggatcaggcttccctatgaactgcagaaaatgcctaatggaagtgcaggagttaaggtgcggtacttagaggaagagagaccttttgcaattgagcaagttactggaatgctgttagccaagcttaaagagacttcagaaaatgctttgaagaaaccagtggctgactgtgtgatttcaattcctagcttttttactgatgccgagagaagatctgtgatggctgcagcccaggttgcaggcttaaattgtttaaggttgatgaatgaaactactgcagttgcactggcgtatggaatttataaacaggatcttcccccattagatgagaaaccaagaaatgtagtatttattgatatgggacattctgcctatcaggtcttggtttgtgcttttaacaaaggaaaacttaaagtcttggctactacctttgatccatatttgggtggcaggaactttgatgaggctttagtagactacttctgtgatgagttcaagaccaaatataagataaatgtgaaagaaaactctcgggccttgttgcgtttatatcaggaatgtgaaaaactaaagaagctaatgagtgcaaatgcatcagatcttccattgaacattgagtgtttcatgaatgaccttgatgtttctagtaaaatgaacagggctcaatttgaacaactgtgtgcttcccttttggccagggttgaaccacctttaaaagcagtaatggaacaagctaacttacaacgtgaagacattagtagtatagaaattgtaggaggagcaacacgaattcctgcagtgaaagaacaaatcactaaattctttcttaaagacataagtaccacattaaatgctgatgaagctgttgcaagaggatgtgcgttacagtgtgcgattctctcaccagcatttaaagtgcgtgaattttccataacagaccttgttccctattcaatcacattaaggtggaagacctcttttgaagatggaagtggggaatgtgaagttttctgtaagaaccatcctgccccattctcaaaagtcattactttccacaagaaggaaccatttgaactagaagcattttatactaatttacatgaagtgccttatcctgatgcaagaattgggagcttcactattcagaatgtttttccacagtctgatggtgatagttccaaagtgaaggttaaagttcgtgttaacatccatggaatcttcagtgtggctagcgcatcagtaattgagaagcaaaatttggaaggcgatcacagtgatgctccaatggagacagaaacttcatttaaaaatgaaaacaaagataatatggataaaatgcaggttgatcaagaagaagggcatcaaaaatgtcatgctgaacacactccagaagaggaaattgatcatacaggagccaaaacaaagtcagctgtctcagacaaacaagaccgattaaatcagacacttaaaaaaggaaaagtcaaaagtattgatctaccgatccagagtagcctatgtagacaactaggccaagatcttctcaacagctacattgaaaatgaggggaagatgatcatgcaagataagttagagaaagaaagaaatgatgctaagaatgccgttgaagaatatgtatatgattttagagacaggctgggcactgtctatgaaaaattcatcactccagaagacttgagtaaactgtctgcagtattggaagacacagaaaattggctttatgaagacggagaggaccaacctaaacaagtttatgtggataagcttcaagaactaaagaaatacggccagcctattcaaatgaagtacatggagcatgaagagagaccaaaagccttaaatgacttgggaaaaaagatccaacttgtcatgaaagtgatagaagcttatagaaacaaggatgaaagatatgatcatctggatcctactgaaatggaaaaggttgaaaaatgtatcagtgatgccatgagttggctgaatagtaagatgaatgcacagaacaaactaagtctcactcaagatcctgtggtaaaagtttcagaaatagtagcaaagtcaaaggaactggataatttctgtaaccccatcatttacaagcccaaaccaaaagcagaagttcctgaagacaaaccaaaagctaatagtgaacacaatggcccaatggatggacagagtggaactgaaactaaatcagattcaacaaaagacagctcacagcatactaaatcctctggagagatggaagtggactaagtcttaattttaccttcacattaattcaaaccgtgcaagtaaccacggggtccatcttttacatctggtacacacaacagacgctcagttgttcttaaccacttttgtcatttgttttttggagtagttttgaaaagtgttttatattgagtgcacttctgttcatttccattgctgcttatatgcagtgttagccgaattagatttacaagacaatctaagctttccggataattttatatatcaaacatacaggatggatacatagttggcaacagtctaccttatttaaagcttctactgggataaacctcaattcctttattcaggaaaggatactttattgcattattgttgcagaagcatagatttaattgcatctttattttgaaaaacaaatgaaaattgatggggtttaaagctacagaggcactgacctttttctagttattgtattgctacaatttaaatattaaaacaaataagagctttcccaaaaaaaaaaaaaaaa

SEQ ID NO: 236 - DNA, 60 bp, Homo sapiens
ccattgctgcttatatgcagcgttagccgaattagatttacaagacaatctaagctttcc

SEQ ID NO: 237 - DNA, 2273 bp, Homo sapiens
gccttagctcccgcgctagagagaaacatgtatcgttttcgatcacagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttccacactgaaaaaaaaaaaaaaaaaa

SEQ ID NO: 238 - DNA, 60 bp, Homo sapiens
ttccaacagaaaccattaaatttggtcctgaacgcatgtatattgattgctgggtaaaaa

SEQ ID NO: 239 - DNA, 7239 bp, Homo sapiens
cacctcgcggccgtaggctaacgtggaagtcggaccagccggccggcggaagaacctagagcgcgctgcctggcgagtcaggcgcgcggggcggcgttggtggtcttcgcggcgcaactcggcctttcctgggagggagtgatggggcgcaccggggccggggagcgggcgccagtgtagcccgcgcggcgcctggcccggagcgcggcggctgcggcggcggcggcggcgggcgctggaggcctgtgagagccgcagcccggagcgcccggcttcccacgccatggcccccatgggcatccgcctttccccactgggggtggcagtgttttgcctgctggggctcggcgtgctctaccacctctactcgggcttcttggccggccgcttcagcctcttcggcctgggcggcgagcctggcggcggcgcggcggggcccgcggccgcggccgatgggggcaccgtggacttgcgcgagatgctggctgtgtcagtgctggccgcagtccgcggcggcgacgaggtgaggcgcgtccgcgagagcaacgtcctccacgagaagtccaaggggaagacgcgcgagggagccgaggacaagatgaccagcggcgacgtgctgtccaaccgcaagatgttctacctgctcaagaccgccttccccagcgtccagattaatactgaggaacacgtggatgcagctgatcaggaggttatcttgtgggatcataagattcctgaggatatcctaaaggaagtaactactcctaaagaggtaccagcagaaagtgttactgtctggattgacccacttgatgctacacaggaatatacagaggatcttcgaaagtacgtcactactatggtgtgtgtggctgtaaatggtaaacccatgctaggagttatacataagccattttccgaatatacagcttgggcaatggtagatggtggttcaaatgtgaaagcccgctcttcctacaatgagaagaccccaaggatcgttgtgtctcgttcccattcagggatggtcaaacaggtcgctcttcagacttttggaaaccagactacaattatcccagctggtggtgctggttataaagttttagcacttttggatgtgcctgataagagtcaagaaaaagctgatttatacatccatgtgacatacatcaaaaagtgggatatatgtgctggtaatgccatcttaaaagccctaggggggcatatgactaccctgagtggtgaagaaatcagttacactggttcagacggcattgaagggggactccttgctagcatcagaatgaaccaccaggccctggtcagaaaactcccagatctagaaaagacaggacataaatgagcataactgattacagggtacagttcttcacagctgaaatggttagcctgagatgctggaagcttcaaaggattggtggagactatgcatggttaaggccatcccgaactttttaaagtatttatgaagcatcagagacttattttccctgtaatagaatgcaaaatcagggaaaatgggttgctttgtgtctcaagtattgtctttatttttgagactattttcatacagttgtcatacacaaggcgcatatatatatttgtgaattaaaatctgtagctgagtctacattgttatgagtcaccattttcacacaacatcatgaatcttcactgttagtactttcatatagaattcggttgaaggaaagattgatttttgtgtagatgtttaatataactttacaactatatctcattgaaaataaagtcattggggatttttacctctaatttggatggaaagcacaagaagccacacattcattaatatgcaacaaatgttgtatttatgttactgaatatttctatggattaaaatagaaaaagtttaattgattttttcttttaaattttaataacaggttcaccagctggtagaaaatagagacacatgatgatttgcattgtaataatttctgtgtgtatgtgtgtgtgttgttttgtttttataaagaaaagtgtgtttgtacccatgagttcagcatttctgccatcttgctattttcattttccctgtggaagatgcatggttgcatccttttccttctgaccaacacttagtctttaactttgtaaggttcggtttaaggtttcagggttagcactatagttttggttcattttctcattaacgataaaatatgctgtaaggcactataagaatataaatgattctattacaattgaaagttacttgacattacatgaattgaactgcctttcattatcttcagacactttgttttagtatttttttttaatttgctaggtttgtatatagaagatcctttcattatcaagaatgagtatggttgcttttgccatggttgcttttactattaataaatgtatctagcctacccaaactctgtagtaacttttgagattctcttaatttcccctcagattaaaatagagaaggttgaaggtactttttgatgaaatttttttctagtctggttagaaaaaaaaagttgtgacatattcattgtgttaccgtaactagaaccttgctttgtgaactgtctttcattgggatgtatggtttctctcaatgtgaaatctggaaacttcatgtaaactacccatgccgttatttcatgtgactccagtgcccttgtattccataacatgctgatgagagggatttctcacggtttctttctttgctaaattttttaaccataaagcagcttaccctttattttcccatcttggaagtaaaattgaccaaagaatgtacgttctagcctggtggaatgtgcatactttaggtttgtatgttacattgtccaaagccctttactttcttattagtaaactgaatctaatatgacacaaatgttttcacccaatctcttgcaactggtcaaattcgagaaggtgttgggccttagcagtaggccttttcagtgaaaattcattcaaagttttggtaggtggaacacttgatatttaaataggacttgaaaattttgaaaagagtatcagagacctcatttttttcctttgcaataagctgaagaaactttctttttcaggagagatggcaaaggtatatgctgttgccagagtcctgtggtataagcatctgtttttattatagtatgtcaaagttagggaaatgggactggcaagtaaaaaatggaatttaatttcaatgttttatgggaactctgatttaatgggaagcaaactagttcatattagcaggaattattttattttttcgagacagagtttcactctcgttggccaggctggagtgcaatggcgtgatctcggctcaccgcaacctctgcttcccgggttcaagcgattctcctgcctcagcctcccaagtagctgggattacaggcatacaccaccacacccagctaatttttttgtatttttgttagagacagggtttctccatgttggtcaggctggtctcgaactcccgacctcaggtgatccgcccacctcggcctcccaaagtgatgattttatttttatttttaattgtattaatctgcatctagataatgactttgtgaagggtgtgtgttgtgtgcaaaacttaaggtattggttgagagttaaatacattatttttataatatgttgggtatagtctagttactaatgattttttttaagtacttttataaaaagttcatttttaaaattgtttgtttttaaaagccaatatacgttgcagaattaggaacagtatttatatttatttacacaagacattgtgccatagcatcctagtaaaacaccttcatgaatgagtaatgttatctcccagaattacattaaaattatttctaaaaagtagcaaagtcattaccttttgcttttaatgacccacacctcaccagctcctggtcttttcttcactgttgcccttattttgaggcaatttttcttaaaatatgacttttatgcaccacatttagtagaggcagtgacatcagtgatctcagtacccatcagctgtccccctcctctgcccttcttcatctcttctaccttgtgaccatttcccttaccggttcatgttctcctttatctctgcttttctttcttagccaggatacttccctcacaactctcactcccaaattcttttagatatacatttttctggatattggctgctgaaatctgaagctctggtaaagttcctagtatcagagatcaatcctggaggaggcctagttcactattagattacaaagactcctcacaaagtaaaggaaaatcaccttcaaaaccacaaccctttatgttgtcaagtctaatatgagtgtttttacgaagtatttctttctacccattgttcaagaatgtaaatgtaaaaaaaaatacaagagagttgggtagatatgcatgcttgaggaaacttgcttttactgttttcctacttgtatccccagttcagttgaatttacaaggacctacaagatggtcatgtttgtcttggtatgtgctaccccaattttagtgtttctttctttattttaaatcagtaattattcagttgattgtttatactatataatgaagtaacaaaaacattttggtttgtatgttttaagtaacagttgtgcaaattcctcttgtttgttaggtgctccctttgaatattttgtgaactgtgtcagagggagaggggtggtggctaggaagagggtcagaaagaagctagagggaggtcaggagaagggtaacagggaggatgcaaagcagacatctaccctggtcaccccaggatcaggatatctgtccttgtttcatgttgaattcaaaaattggatctcacttaggctttgaaggtgacagccatctctgatagctgagcataagtaaagaaaggtggagtgccgatgcagaaaggaaaatattcagctttcctctcttagatcgcactttgaagatggccttttggagacaatctgacaggttaaaacaggaactgttggaattattctagctgtaactacctattggctatgtgttgattgatcctagaaagaaaaaataatttttcattttagatcttgattgaatttaagatgtatttatatgcctacaaaaggtctgtcttgtaactgttgtataaaataaacctaatctatggtttcatttttaatctaaaaaaagttgtgccttaacaatagggcattgtatgttaataagggaaaacaacctttttagtagatgggggaaaataggaactttttgccattaaaacttaagttcttttgatgtttttaatattatagttgggggagattcattaaaattaaattgaaataaaattatttttgcataacctagcatttacaactaaagtatgttttttataagaactggcatcttgatgtatataggtctgaaataatatttcatcttttgatttttaattttaataatattagaccaggatagatcacagttttacaaatcttagttttaaataaattatttcagtgtgctgttagtcctctacagtcattttggtttaaaaagtgactatttatttatggtagcatatcaataatttattaatgttaaaaaatactgtgtatgacattacaaaccagaacagttcctgggggagaggattctaattgattggcagttctgagagggcaagaagaatggaactttatacttcaaaaggaggttttggttttaccaggtactgcttatgtaaatcgtttatttttatttcatcaaagcctggcaagtatatgcattccaatttaccattggcaaagctttatttatttttaaggttggatgttgaattaattttgtgggaaaatgagatttgtaagtagttttctttctagataagataacataaaccaaactttcagaagttaaggatgatgaataatattgaaatgacttgttatatattgtaagggttcccttaagtatcataattaacaatttgtggaaattgaaaaagcataaactgtgttatttgattagtaatatgttcccttaaaattcattttgaggtgtatgttatacacacagtaaatttttgttcaggaatgacttgctcattctgtgtttttaaaaataggaaataaggcatagtgagtcatcattacatcaattaaccaaaaaatatttcatcccctccgtcactgaaattatctacttcagccacctttcttattctcgtgttaggagggcacgtttatggactttttaatttccatgtgccatattgtccactaccggcagtagccaaagctagctgtttcagtcccacagaagagacagtgctctgccatgatgacagggcactgctagggctggtttttcttgtttttcccttttggcagtgtggacttcaggaactagatgtatatgcacaagggattgagtttacactaaaactaggaaatggagttttcaatctatgttcttgcctcttcatacttttatttattttttgtcatcctgccttatactgggctaacaatgagataaaataaaaatacctttgaatactcttttccctttcatgcatttaaagccatggaggaactagaccattagctgttgccgtcacatgcttagacaccagtttacttagcgtgttatgaccttcctcacccatactaccaaatttaaatgggtcccgacttcaccctctggaaggaagtaaactcttctctccccatggtttcagagcagtttttacctgcaagcaccatctctgtatgtgctcttactagattatacagttcttgagagggattgcatcttagtgtttttgtatttccacctcacccccagcacatagcccagtctcttgcacaaattaagtacttaatgtgtgttgagctaaattgaataaaggattattagcattagcatattttgtgccttggttgtataagctggttgtttgttttgttacctttgcaaatatttatgattatcacccccccacatactaaattgtttttaaaagttttgcctttccttcagatactaccccaggcaatttgctgtagataatgtgattgcttccaatgacataattatcccaaactctctgccccggatatactttgccaaacgaaatttgaattctctgaataaattggtcatgtctaaaagagaaaaaaaaaaaaa

SEQ ID NO: 240 - DNA, 60 bp, Homo sapiens
gatttatacatccatgtgacatacatcaaaaagtgggatatatgtgctggtaatgccatc

SEQ ID NO: 241 - DNA, 1527 bp, Homo sapiens
ggcggacaaagcccgattgttcctgggccctttccccatcgcgcctgggcctgctccccagcccggggcaggggcgggggccagtgtggtgacacacgctgtagctgtctccccggctggctggctcgctctctcctggggacacagaggtcggcaggcagcacacagagggacctacgggcagctgttccttcccccgactcaagaatccccggaggcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatgaaaaaaaaaaaaaaaa

SEQ ID NO: 242 - DNA, 60 bp, Homo sapiens
ctttcttcactgcagatttctcacctgtaagatgaagataaggatgatacagtctccatc

SEQ ID NO: 243 - DNA, 3816 bp, Homo sapiens
gcagcgccggggccctcagatcgaggctgcctccccctctcagccggcagcacattccgtcgccttgccgccgcccggccccacagttgtctttgccggagctgcagtcgcgctggggttagggcgggggggcgggcggggagaggagaaggccgcggcggaggcaggtgagaggaggaaggaagcggcggcgcggcgggcacagcagctcaggcggcggcccggttcctgggagtgtcggtgcggcgcgttggttggggcggatcccgcggggcccgggcgggggaaggagtcaccggcccggccatggcggacaacgagaaactggacaaccaacggctcaagaatttcaagaacaaaggccgcgacttggagactatgagaagacaacgaaatgaagttgtagttgaattaaggaagaataaaagagatgaacatctcttaaagagaaggaatgtaccacatgaagatatctgtgaagactctgatatagatggtgattatagagtgcaaaatacctctctagaagctattgttcaaaatgcttcaagtgataaccaaggaattcaattaagtgcagttcaagctgctaggaagcttttgtccagtgatcgaaatccaccaattgatgacttaataaaatctggaatattgcccattttagtccattgtcttgaaagagatgacaatccttctttacagtttgaagctgcatgggctttgacaaacattgcatctggaacttctgaacaaactcaagcagtagttcagtccaatgctgtgccacttttcctgaggcttctccattcaccccatcagaatgtctgtgagcaagcagtgtgggcattgggaaatatcataggtgatgggccccagtgtagagattatgtcataagtcttggagttgtgaaacctttactttccttcataagtccatctattcctataacattcttaagaaatgttacttgggttatggtcaacttatgtcgccacaaagacccaccaccaccaatggaaaccattcaggagattcttccagccctttgtgttttaattcatcacacagatgtaaatatactggtagacacagtctgggccctctcttaccttactgatgctggcaatgaacaaatacagatggtaatagactctggaatagttcctcatttggttcctctgctcagccaccaggaagttaaagttcagactgctgcacttagagctgtgggcaacattgttactggaactgatgagcaaacacaagtagttttgaactgtgatgctctttcacacttcccagcactcctgacacatcccaaagagaaaattaataaagaagcagtgtggttcctctccaacatcactgcaggaaatcagcagcaggtacaggcagtaattgatgccaatcttgtaccaatgataatacaccttttggataagggggattttggcactcaaaaagaagctgcttgggccataagtaacttaacaattagtggaaggaaagatcaagtggcttaccttatccaacaaaatgttatcccacctttttgcaacttgctgactgtaaaagatgcacaagttgtgcaagtagtactcgatggactaagtaatatattaaaaatggctgaagatgaggcagaaaccataggcaatcttatagaagaatgtggagggctggagaaaattgaacaacttcaaaatcatgaaaatgaagacatctacaaattggcctatgagatcattgatcagttcttctcttcagatgatattgatgaagaccctagccttgttccagaggcaattcaaggcggaacatttggtttcaattcatctgccaatgtaccaacagaagggttccagttttagaaagatgttgtggaagttaggtacaatgcagcactgagatatatatatatatatgtgtgtgtgtatatatatatatatatacatatatataaaaaggtttgatccatcaagcttggctcatgggatctgctgctgcattaaatcgggaaagaaaatgtgaagatttcatttggaatcacagaaaatgcccaaatgaggtcaagatggcgagtgggtgcgagtgagaatgagtggcaaaatgtaatgaaaactttacatgaatgcttatttaggttgttcaaagtaaaaagggctacaggtcacagatcgtcagtgcctgagaaagaacattgacttactctatatcaattgaggggaaagtgcagtaccgtcatcttcaagccttgtaagcataaaagagaataggctgcccatataagtcaaaggaaaatgagcccaggccttgctatgaagcagtgtgtgaatggacaatgttgaatgaatgtctggctcagtgatggagagccaggttcatctttgaaatctagggctcttcactcatgaagcagactcctagtcctggagtgactgtgtacgagagcgtggttgtggtgctgtatgtgaacgcatgcaagcttgattcaccttcagggggctgataacctagtaaatcatcaaaatgagatcataagtgttaatgtacactggacatgaaaacaaagactggtttagcagcagacattggtttactctgcagcctgtgttttctgtttccccctttcccacctccttccccccacccaatccttttttttttcttttttgcttttcttttctttttttttagtttttatttactttacctagtatgcctttttttagttgcttctcaagtcagaaaacttttcaggaaggtttccctgtgcatttgcaccagatgaatgtttgatgctatgaaaagctttccatatcatcaaaactaatttgtgtagatttttgcatgaaaaaaatcataaatttccctcaaaatagactgtgttgcagtacacaagttgccataatagtataaaacagtaaaatgtgcttaaaaggccatccttttcattttcagagataacataaagatctttgcatgaggtaaatctacagcatagttcatttttagattttgttgagtcctgtaaagaagaagaagaaaaaagtttcagttgtggtagaataccgtgctgtgtttaaatgttacttgttttcaaactttgttttctatgaaaatgatatggaaacttctaaaatggaatttggtgcatatgtactgctgaataaagaccgatgaagaggtttgagtagatgtacaaatcaagtaatggtttgaacacctttaataatatgcctaatctgttcaattgttttagaatctttttatcttagatgtaggcagccatgaacaatctattttgagccactttagggagaaaactttgtatttttaaaacttgcataaaagttatgcaagtggtttttataaattggaataatacctcagttttgaggttatgcacactaaattaaatgtgacataaattaatttgtacaaaaagaactctttataaggtggctcattgtaggaaatcctgtgccttcccctttgagcacaagtgttgcatgaacaacagtttgctataagaaacataccagattagccaccattagcatctatatctactttgtgtttaaaaatcaactggtaattctgaaacactgtagaatggataaaaattattttgtgatcataactctttgttgaactagagtatttttgcagcattccttgtcatcagaaacatggttaaagtttaaaactagaagcagcagaaaactagcttgtaaaatttatccaagtagagtgcaggctaggctgtcttggggaaataaacattaaaacttaaagcaaaaaaaaaaaaaaaa

SEQ ID NO: 244 - DNA, 60 bp, Homo sapiens
aagatgcacaagttgtgcaagtagtactcgatggactaagtaatatattaaaaatggctg

SEQ ID NO: 245 - DNA, 4528 bp, Homo sapiens
gccggggcgggcggcagcggcggcggcggcggcggcgggggcagcggcaaccccggcgccgcggcaaggactcggagggctgagacgcggcggcggcggcgcggggagcgcggggcgcggcggccggagccccgggcccgccatgggcctccccgagccgggccctctccggcttctggcgctgctgctgctgctgctgctgctgctgctgctgcagctccagcatcttgcggcggcagcggctgatccgctgctcggcggccaagggccggccaaggattgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctaccttgtgcgccccgcacgagttccagtgcggcaaccgctcgtgcctggccgccgtgttcgtgtgcgacggcgacgacgactgtggtgacggcagcgatgagcgcggctgtgcagacccggcctgcgggccccgcgagttccgctgcggcggcgatggcggcggcgcctgcatcccggagcgctgggtctgcgaccgccagtttgactgcgaggaccgctcggacgaggcagccgagctctgcggccgtccgggccccggggccacgtccgcgcccgccgcctgcgccaccgcctcccagttcgcctgccgcagcggcgagtgcgtgcacctgggctggcgctgcgacggcgaccgcgactgcaaagacaaatcggacgaggccgactgcccactgggcacctgccgtggggacgagttccagtgtggggatgggacatgtgtccttgcaatcaagcactgcaaccaggagcaggactgtccagatgggagtgatgaagctggctgcctacaggggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagcacctcaatctacctcaactacgacgttagcttctaccatgacgaggacagtacctgccaccacaagagcccccgggaccaccgtccacagatccacctaccagaaccacagcacagagacaccaagcctgacagctgcagtcccaagctcagttagtgtccccagggctcccagcatcagcccgtctaccctaagccctgcaaccagcaaccactcccagcactatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagacgaagatgagctccatatagggagaactgctcagattggccatgtctatcctgcagcaatcagcagctttgatcgcccactgtgggcagagccctgtcttggggagaccagagaaccggaagacccagcccctgccctcaaggagctttttgtcttgccgggggaaccaaggtcacagctgcaccaactcccgaagaaccctctttccgagctgcctgtcgtcaaatccaagcgagtggcattaagccttgaagatgatggactaccctgaggatgggatcacccccttcgtgcctcatggaattcagtcccatgcactacactctggatggtgtatgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctgggggggcttttttaggttttggggcatttgttttttgtaaataagatgattatgctttgtggctatccatcaacataagtaaaaaaaaaaaaaaaacacttcaactccctcccccatttagattatttattaacatattttaaaaatcagatgagttctataaataatttagagaagtgagagtatttatttttggcatgtttggcccaccacacagactctgtgtgtgtatgtgtgtgtttatatgtgtatgtgtgtgacagaaaaatctgtagagaagaggcacatctatggctactgttcaaatacataaagataaatttattttcacacagtccacaaggggtatatcttgtagttttcagaaaagcctttggaaatctggatcagaaaatagataccatggtttgtgcaattatgtagtaaaaaaggcaaatcttttcacctctggctattcctgagaccccaggaagtcaggaaaagcctttcagctcacccatggctgctgtgactcctaccagggctttcttggctttggcgaaggtcagtgtacagacattccatggtaccagagtgctcagaaactcaagataggatatgcctcaccctcagctactccttgttttaaagttcagctctttgagtaacttcttcaatttctttcaggacacttgggttgaattcagtaagtttcctctgaagcaccctgaagggtgccatccttacagagctaagtggagacgtttccagatcagcccaagtttactatagagactggcccaggcactgaatgtctaggacatgctgtggatgaagataaagatggtggaataggttttatcacatctcttatttctcttttccccttactctctaccatttcctttatgtggggaaacattttaaggtaataaataggttacttaccatcatatgttcatatagatgaaactaatttttggcttaagtcagaacaactggccaaaattgaagtcatatttgaggggggaaatggcatacgcaatattatattatattggatatttatgttcacacaggaatttggtttactgctttgtaaataaaaggaaaaactccgggtaaaaaaaaaaaaaaaaaaaaaa

SEQ ID NO: 246 - DNA, 60 bp, Homo sapiens
gtcagtgtacagacattccatggtaccagagtgctcagaaagtcaagataggatatgcct

SEQ ID NO: 247 - DNA, 2575 bp, Homo sapiens
aaagattccttagctggaaaggtctaggaggagactcccgctctgctccctcctgcaccagcgctgtgccccccgccggccaggcagagccatccgatgccgctgggccgcccactgaggatctgctggctgcagcgagtggaaggacctgctcggctggaacgttttttttttttttccctcccaggcgacgtccgatgggtgtgtcgggcaggaggtgatatttgacaggctgcgcgcgggcgagctgccgcggagcacccggcaggggctgacagcatggcctcgcccgacccgcccgccaccagctacgccccgtccgacgtgccctcgggggtcgcgctgttcctcaccatccctttcgccttcttcctgcccgagctgatatttgggttcttggtctggaccatggtagccgccacccacatagtataccccttgctgcaaggatgggtgatgtatgtctcgctcacctcgtttctcatctccttgatgttcctgttgtcttacttgtttggattttacaaaagatttgaatcctggagagttctggacagcctgtaccacgggaccactggcatcctgtacatgagcgctgccgtcctacaagtacatgccacgattgtttctgagaaactgctggacccaagaatttactacattaattcggcagcctcgttcttcgccttcatcgccacgctgctctacattctccatgccttcagcatctattaccactgatgcacaggcgccaggccaagggggaaatgctctttgaaagctccaattattggtccccaaaagcagcttccaacgtttgccatctggatgacaaacggaagatccactaaaacgtccacgggattaacagaacgtccttgcagactgagcgatgacaccacactttgtttggacatttaaattcactctgctgaataggaggaagcttttctttttcctgggaaaacaactgtctcttggaattatctgaccatgaacttgctcttctagacaactcacatcaaagccctcactccactaatggagaatcctagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccatgcccggctaatttagttgtatttttagtagagatggggtttcaccgtattagccaggatggtctcgatctcctgacctcgtgatccgcccgcctcggcctcccaaagtgctgggattacaggcgtgagccaccgcgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatctgcatgaagccaattttgagggtagacgtgtggggaaaataaatcattatacagtaagacctggggcttgaggggtggggaatggggagggaagggcatagcctgctcctccatgagtctgacatctcggaaactgagcagctgccggacgcctgggtcaggaatccaagaccccacctcttaaggactggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggcctggcggaatggtggtgcccacggggttgggcaagggctcaccaggacctcaacgggcaaagttgtgcacactaaaatatcaaatcaaggtgcttggttttaaagtaaatgtttttctaaagaaagctgtgctcttctgttgacccagacgaatagggcacagccctgtaactgcacgtgccttctgtcattgggaatgaaataaattattacgagaaagggacttgtcctaactggtttgaggccttacagttttgtatctacatttttcccctcctggggtttgcggggacagggacagaactacaggagtcatgggaaagaaaattctggcttcactactgctcactgctcactttctgatcactctgatactttttttttttttttttttttgcaacctgataccttgaaaagcttctatgtgtctctccttttgttgcctggcagctgtctaggatgatcactgattactatttactaagtagccacatgcaaataaaagttgtttggtaaaaaggaaaaaaaaaaa

SEQ ID NO: 248 - DNA, 60 bp, Homo sapiens
aatagggcacagccctgtaactgcacgtgccttctgtcattgggaatgaaataaattatt

SEQ ID NO: 249 - DNA, 3613 bp, Homo sapiens
ccactccgcaccccaccctctgtctggtacagcttaccaaaccaaagtgcccaaagccgtgacatcccggccggcggctcgcaggcccccgccctccgcacgtcacggccgccgggtgcagtgccccctaggggcccctgggacgaggaggaagcgccaggtccttcccgccgccgccgccgccgccgccgcctgctcccctggcacgcgccccgccgccctcggcagccgcagctccgtgtcccctgagaaccagccgtcccgcgccatgggcacgcgtctgccgctcgtcctgcgccagctccgccgcccgccccagcccccgggccctccgcgccgcctccgtgtgccctgtcgcgctagcagcggcggcggcggaggcggcggcggtggccgggagggcctgcttggacagcggcggccgcaggatggccaggcccggagcagctgcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaagtggacaaggctctcacaggacccgatgcagactcctgaaacagactactctttgcctttttgctgcagttggagaagaaactgaatttgaaaaatgtctgttatgcaatgctggagacgtggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaaaaaaaaaaaaaaaaa

SEQ ID NO: 250 - DNA, 60 bp, Homo sapiens
tccactctcaagttttctactttgtctttgaactgaaaataaacatggatctagaaaccc

SEQ ID NO: 251 - DNA, 3847 bp, Homo sapiens
tcagaactcacacttcttcctggcaaagaagtgcccaggacgggagctggggagccagggctgatctaggaggctgggagccaggtgacaggatggccccaaagagagttgtgcagctgtccctgaagatgcctacccatgccgtgtgtgtggtgggagtcgaggcacatgtggacattcacagtgatgtgcccaagggtgccaacagcttcagggtctctggaagctccggggtggaggtcttcatggtctacaaccgcacacgtgtgaaagagcccataggcaaggcccgttggccgctagacactgatgcagacatggtcgtatctgtgggcacagccagtaaggaattaaaggacttcaaggtgagggtctcctactttggggagcaggaagaccaagctctgggccgcagcgtgctttacctcactggcgtcgatatttcccttgaggttgacacaggccgcacaggcaaggtgaagaggagccaaggggacaagaaaacctggcgctggggccctgagggctatggggctatcttgctggtgaactgtgaccgggacaatcacaggtccgcagagcctgacctcacccacagctggctgatgtcgctggctgacctgcaggacatgtccccaatgctgctgagctgcaatggccccgacaagctcttcgacagccacaagcttgtcttgaacgtgcccttttctgattccaaaagagtgagggtcttctgtgccaggggtgggaattctctctcggactacaaacaggtgctggggccccagtgtctgtcctatgaagttgagcgacagccaggggagcaggagatcaagttctatgtggaggggctgaccttccccgatgccgatttcctagggctggtttccctcagtgtcagcctggtggacccggggaccctgcccgaggtgaccctcttcacagacactgtgggcttccgcatggccccctggatcatgacgcccaacactcagcctcctgaggagctgtatgtgtgcagagtgatggacactcatggctccaatgagaaattcctggaggacatgtcttatctgacattgaaagccaactgcaagctgaccatctgccctcaagttgaaaatcgaaatgaccgctggatccaggacgagatggagtttggctacatcgaggcccctcacaaatccttccccgtggtctttgactcccccaggaacaggggcctgaaagatttcccctataagaggatcctgggtcctgactttggatatgttacccgggagatcccgctccctggtccctccagccttgactccttcggcaacctggacgtcagcccgcccgtcacggtgggcggcacggaataccccctgggccggatcctcatcgggagcagcttccccaagtccggtgggcggcagatggccagggcagtgcggaacttcctgaaggcacagcaggtgcaggcacccgtggagctctactcggactggctctctgtgggccatgtggacgagtttctgacctttgtgcctacctctgaccaaaagggcttccggctgctcctggctagccccagcgcttgcctcaaactcttccaagagaagaaagaagagggttatggggaggcagcccagtttgatgggttaaaacaccaggcaaaaagaagcattaatgagatgctggcagacagacacctccagagagacaatcttcatgcacagaaatgcattgactggaaccgtaatgtgctgaagcgggagctgggcctggcagagagtgacatcgtggacattccccagctcttcttcctgaaaaacttctacgcggaagccttcttcccagacatggttaacatggtggtcttaggcaagtacctgggcatccccaagccctacgggcccatcatcaatggccgctgctgcctggaggagaaggtgcagtccctgctggagcctctgggcctgcactgcatcttcattgatgactacttgtcctaccacgagctgcagggggagatccactgtggcaccaacgtgcgcaggaagccctttcccttcaaatggtggaacatggtgccctgagcctgcccccacccgccatcctctctgccctcttgctagggaaccctgccagggtgaaggcaaggaacaaccacctggcctccattctcttgggggagtcttggcactttgcaaacatcctggccaccatgggcaccaggacacagggatggataccacctaccctcgcctctggaatggcctacccaacccgagaagaatgcacctcattcttccctggcctctttcccacccacagcccccagaggctctagatcaacaatgttagcatgttccagaatggctgtgggaggcctagggagatgggccccacttagaattgctcccccttcattctgatgcctccctggggaacaaggataatgactttgcatctgcacctggaacggggcctgggggacctggggtctggtgtgccaggcaccaggctgcctctgctcttggaaaactaggaaaggggatcagaaacatcctctccccgctctaggtttcttctcccaaaggggacccaaggctgtgacacttacctccacccccatccagcacccttcagctgtgtgtggacaaacaaggacagaaaaacccagtgtccaagggccaatttaaatagaaaaaaagacaacaaaattttaatagctgactccgacctcagaagagtgattgctacctttctggaaagactttaattaccagagctggcttctcccagctcagaaatgctgagaagccaacgtgaggcctgaggacacacaaaggatgacggggcaggaggggatgaggtcagggtagcagagtgtgtgacgacggatttgggggcctagaggtgtccgtggttcctgggctgggattttggactctggatttgaagggagctggagcttccagatgtagcaggggtagggggccagatgttagaagagggtgtgtgtgttgggaggaaattaggttatctctgaaggtggagtttaatttcctttaatagtctttaattattccccttcattctgcaggcagtgggaggggaaggcttgcccggtctctctcagcaacccagggaccctgcacatagcttaggtttcatccctgaataaaccgctgtgcaggcccatgtcccctcccacagtagggaagacagctgccacgggaggttaatagcccggagtgaggtcactgagacatgcacaggcaggctggttcagctgggctgcagggcacgggcaggaggaagccagcctaccctcttcccccactgccagtgaggccattgtagggcagttggccctagggcttcggtccatctaggttttcagtggcccctgctgagacctcacactgagccaactactgtcactgttttaaccaacaaaagctagcctggaactgctatggttaaagtgggtgagcgggaacctgaaaatccccttctggaaggttctacagaactctatttgcaagctcctgctttaacctgagcgtcctctgctcaggatcataccccagcctgcactgagtcaagaaggagaaggaggctctgaaggggccgggggtgtgagctggggttgggactcccctgagaaagagctgtgggtaggaagggagtgagcattgcagagatagggctgggggtcggggccacactgagtgtgggaagctctggagttgctgctgggccatcgaggggccctggtgttggctctgagaatgttctgggtgaccagtcacctactttctgatcaataaaaatgtcgacatgcatttcttac

SEQ ID NO: 252 - DNA, 60 bp, Homo sapiens
cagctgtgtgtggacaaacaaggacagaaaaacccagtgtccaagggccaatttaaatag

SEQ ID NO: 253 - DNA, 2628 bp, Homo sapiens
gcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccacctgctccagtgcgtgctgtctgtggagtgtgtctcatgctttcagatgtgcatatgagcagaattaattaaacatttgcctatgactccaacaaaaaaaaaaaaa

SEQ ID NO: 254 - DNA, 60 bp, Homo sapiens
tcagctgtgcgcgtgggcattgccgacggccacaggatgctcgccatctatgatggcttt

SEQ ID NO: 255 - DNA, 4579 bp, Homo sapiens
ctgcggagtgagccaatcagggcacagcctgcgttgaccgcgtgccgggtgtcatggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataaacttgctatggagagactctatgcagtttttacagattacgagcatgacaaagtttccagagatgaagctgttaacaaaataagattagatacggaggaacaactaaaagaaaaatttccagaagccgatccatatgaaataatagaatccttcaatgttgttgcaaaggaagtttttagaagtattgttttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgagtttcctccttatgcaactaatgaaattggcaaagtcactggtttaaatagaagagaacttgggcatggtgctcttgctgagaaagctttgtatcctgttattccccgagattttcctttcaccataagagttacatctgaagtcctagagtcaaatgggtcatcttctatggcatctgcatgtggcggaagtttagcattaatggattcaggggttccaatttcatctgctgttgcaggcgtagcaataggattggtcaccaaaaccgatcctgagaagggtgaaatagaagattatcgtttgctgacagatattttgggaattgaagattacaatggtgacatggacttcaaaatagctggcactaataaaggaataactgcattacaggctgatattaaattacctggaataccaataaaaattgtgatggaggctattcaacaagcttcagtggcaaaaaaggagatattacagatcatgaacaaaactatttcaaaacctcgagcatctagaaaagaaaatggacctgttgtagaaactgttcaggttccattatcaaaacgagcaaaatttgttggacctggtggctataacttaaaaaaacttcaggctgaaacaggtgtaactattagtcaggtggatgaagaaacgttttctgtatttgcaccaacacccagtgctatgcatgaggcaagagacttcattactgaaatctgcaaggatgatcaggagcagcaattagaatttggagcagtatataccgccacaataactgaaatcagagatactggtgtaatggtaaaattatatccaaatatgactgcggtactgcttcataacacacaacttgatcaacgaaagattaaacatcctactgccctaggattagaagttggccaagaaattcaggtgaaatactttggacgtgacccagccgatggaagaatgaggctttctcgaaaagtgcttcagtcgccagctacaaccgtggtcagaactttgaatgacagaagtagtattgtaatgggagaacctatttcacagtcatcatctaattctcagtgatttttttttttaaagagaattctagaattctattttgtctagggtgatgtgctgtagagcaacattttagtagtatcttccattgtgtagatttctatataatataaatacattttaattatttgtactaaaatgctcatttacatgtgccatttttttaattcgagtaacccatatttgtttaattgtatttacattataaatcaagaaatatttattattaaaagtaagtcatttatacatcttagaaaaaattacatagttttgtttttacaattctgaaatatatgaaaaacttagatagaatatgtcatatgttattataacagatctcttcctacatcttatttttcttctttgtatacagtagtgacagtttaccttcagtcatcctacaggtcacctctgtgcccaacaactttacttgcctacaacggttcacaaactggaacaggccatattcaaagccagtgcctatttcttcagaactgttaacagatatagtgagttgagggagctaatctgatacacttttgataatataatgcctttcaaattagttaccaaatcataaacagagtggaataaatataaatgagattctaactaggatgaatgtggtagtaatgatgtatatttttcaaatttacctaaacagaaagattattggctaaggcaggcggatcatgagatcaggagatcgagaccatcctggctaacacggtgaaaccccgtctctactaaaagtgcaaaaattagccgggcgtggtggcgcatgcctgtaatcctagctactcaggaggctgaggcagaagaatcacttcaacccaggaggtggaggttgtagtgagccgagattgcgccattgcactccagctcaggcaacaagagcaaaactccgtctcaaaaaaaaaaaaaaaattgtttacttatcaaattgaactaggtcaatttgaatatgtgtattgctctaatgtatggaagttcttagtataagagctgaaggatcatgactttcggttaatagatgtttgaaatagatgtttagaggttactgatacacatgtcaagttgttcattcccatcatttaaaatatcaccttataattccacagaaaagtaaatggtatgtggacgtcataatttagaatgtgtaatcttttttaaaatcttataaaaatacactggactcagtggtacgtgcctgtagtcccagctacttggaaggctgaagtgggaaggtcactagagcccagaagttcgacactgtagtgtgcaacaatcatacctgtgaatagctactgtactccagcctgggcaacatagcaggactcttatctctaaaaaaaattttaaatcttataaaaatgtaggtatatctggccaggcatggtggctcacacctgtaatcccaacactttgggaggtcaaggcgggtagatcacctgaggtcaggagttcgagaccagcctggccaacatggtgaaaccccatctctactaaaaatacaaaaattagctgggtgtggtggcgggcgcctgtaatcccagctactcaggaggctgaggcaggagaatctcttgaacctgggaggcagaggtggcagtgagctgagatcgcaccactgcactccagcctgggcaaaaagagtaaaactccatctcaaaaaaaaaaatggtgggcacagaagctcatgcctgtaattccagcactttgggaggccgaggcgggtggattacatgaggtcaggaattcaagaccagcctggccaacacggtaaaaccccatctctactaaaaatacaaaaattagctgggcatggtggcaggcacctgtaatcctagctactcgggaggctgaggcaggagaatcacttgagcctgggaaatggaggttgcagtgagccgagattgcgccattgcactccagcctgggcgacagagcaagactccgtctccagaaaaaaaaaaaaaaaaggtaaattcatgactcagggttaactagttcataaaatattacaaatttatctggctaaaccaaagatttttaagtcaataaacattgattatatatctattgtgtgtaaaatagcatgttaggcaatgttgatatacttctgaaatattaaagattaattgaaaatgaaagattaaatttatttgctttctacactt

SEQ ID NO: 256 - DNA, 60 bp, Homo sapiens; identical to SEQ ID NO: 151

SEQ ID NO: 257 - DNA, 1450 bp, Homo sapiens
gatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatccatttaaaaaaaaaaaaaaaaa

SEQ ID NO: 258 - DNA, 60 bp, Homo sapiens
ccagataagatttcaggagctgatatcaactccatctgtcaggagagtggaatgttggct

SEQ ID NO: 259 - DNA, 7723 bp, Homo sapiens
atgccgctggcgcagctggcggacccgtggcagaagatggctgtggagagcccgtccgacagcgctgagaatggacagcaaattatggatgaacctatgggagaggaggagattaacccacaaactgaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaagaggtgatgttcacagaagaagatgtcaaattctacttggctgaacttgcacttgctttagaccatctacatagcctgggaataatttatagagacttaaaaccagaaaatatacttcttgatgaagaaggtcacatcaagttaacagatttcggcctaagtaaagagtctattgaccatgaaaagaaggcatattctttttgtggaactgtggagtatatggctccagaagtagttaatcgtcgaggtcatactcagagtgctgactggtggtcttttggtgtgttaatgtttgaaatgcttactggtacactccctttccaaggaaaagatcgaaaagaaacaatgactatgattcttaaagccaaacttggaatgccacagtttttgagtcctgaagcgcagagtcttttacgaatgcttttcaagcgaaatcctgcaaacagattaggtgcaggaccagatggagttgaagaaattaaaagacattcatttttctcaacgatagactggaataaactgtatagaagagaaattcatccgccatttaaacctgcaacgggcaggcctgaagatacattctattttgatcctgagtttactgcaaaaactcccaaagattcacctggcattccacctagtgctaatgcacatcagctttttcgggggtttagttttgttgctattacctcagatgatgaaagccaagctatgcagacagttggtgtacattcaattgttcagcagttacacaggaacagtattcagtttactgatggatatgaagtaaaagaagatattggagttggctcctactctgtttgcaagagatgtatacataaagctacaaacatggagtttgcagtgaagattattgataaaagcaagagagacccaacagaagaaattgaaattcttcttcgttatggacagcatccaaacattatcactctaaaggatgtatatgatgatggaaagtatgtgtatgtagtaacagaacttatgaaaggaggtgaattgctggataaaattcttagacaaaaatttttctctgaacgagaggccagtgctgtcctgttcactataactaaaaccgttgaatatcttcacgcacaaggggtggttcatagagacttgaaacctagcaacattctttatgtggatgaatctggtaatccggaatctattcgaatttgtgattttggctttgcaaaacagctgagagcggaaaatggtcttctcatgactccttgttacactgcaaattttgttgcaccagaggttttaaaaagacaaggctatgatgctgcttgtgatatatggagtcttggtgtcctactctatacaatgcttaccggttacactccatttgcaaatggtcctgatgatacaccagaggaaatattggcacgaataggtagcggaaaattctcactcagtggtggttactggaattctgtttcagacacagcaaaggacctggtgtcaaagatgcttcatgtagaccctcatcagagactgactgctgctcttgtgctcagacatccttggatcgtccactgggaccaactgccacaataccaactaaacagacaggatgcaccacatctagtaaagggtgccatggcagctacatattctgctttgaaccgtaatcagtcaccagttttggaaccagtaggccgctctactcttgctcagcggagaggtattaaaaaaatcacctcaacagccctgtgaagtgacctcagtgagatatttggtaccatggtgtaagctgatagcacaagttctggcgacaggtagcacgtatctgagagacacctgcaagcacacactgtcccagctggtacccataatgctgctgttcctgctgctgctcctgctttcctctcttctcgctttaaatgattgttagcaagttagattttcctggagcttcggaagaaatgaaaatggaaacatgatgaagatatagtcactgaatcaatgagaaaaataatgaacatatgaataccacctaaaaatacactgaataaagtacaccatatagcattatttttataggaaatatttcatgtcccttaaatattctttgttagttatagggatggacagtttatgttaagcacttagcttaaacaatccgtttatattagcactgtatcccttgtgccatccaacattttgtatgtttttgtaaacagttcatatacagtacatttctgtactgctttctttaatgtatacatgccttgtttaacttggaatctattattattaatcaattgactattaaatctggttaaatagttcacctggattaacagtattgttggacagtcctaaaaatggccagattgtggaacagctgttgaatgtaatacttccaaaatgtacatatctttccccacgtctgtttcactggttcgttcatttgtttgtttcttaaagtcaggtgctctgtcagactaacctagagagctgttatggtagagaaagttatcatatgtgtgtggcatgaaatcaagaatacacctatgaagttagtccatatactttgcaactccttagagtacttttttccttaattaaggaagtagtccttgcacttctaatcttacatagcatccatacttagaatttggcatatcatctgggattttgccaatatacgtcaaagccctttaagagtcatggtaaggagatgggtgaaggaaaatttagcaacaggtaattgaagtcctattggatatttcatgtttaaatagatattctatattaaacactaatttaaatgtaataaaggccaaaggcctctgtatgaaattggatttaaactttcttattttagggaataaaacattattgatcaaacagtatctgttctaacctaaaattataggtagggcaggctaagtgaacagcattgagtattttctgaatccctcatgataatttatagccacatactgcttcctttgacttcaggaatgatcagttttcataatggccactgggcctgcttagattgcagtattcattatctgcatctaatttggtagtttccacaatcgtatttgatgaaagaaacttcagtccccattattacctgtgtctttgccaagctgcctagcatacatcagtatgtaatgtaaaagacatatgagcaagaaaaaagtgatttaacttacctcatcaagaatgtgcccctacaggccgggcgcagtggctcacgcctgtaatcccagcattttgggaggccgaggcaggtggatcacctgaggtcaggagtttgagaccagcctggccaacatggtgaaaccccgtctctactaaaaaatacaaaaattagctgggcatggtggcgtgcacctgtaatcctagctactcaggaggctgaggcaggagaatcgcttgaacctgggaggtggtggttgcagtgagccaagatcacaccattgcactccagcctgggtgacagagtgagactctgtctcaagaaggaaaaaaaaaaaaaagaatgtactcatacagatttttgttagtcatcatgtaataagccatttatatcagaaaccttttttcctgccacagaagctttaaattttcccctaagagtacaaagccaagagagtgtggtttatctaaatgtcctgaaatccacttgtcattccttaatttctcctctatgcaattaaagagaaaggggaaatctataacatttcttttgcccaagtgacacaaaaatgattactgcatagaaatcaaatgtaagtttagcttctaaatgaaataatatataggagggatatcagaatgtctagatagagaaagtattttcaaattcttgaatatatggatgctattaaaagctgctttccattgcctggaaagagagcttttttccctcctctattcagtgtttcaaactttggtcatctcaaattattgtcacttttaaaatgttaatgtcattctgagcagaaatagatatattttcagatttttttacactgatgctactccgtaattgcttaggagtattgtccatcatagtattttagaactagaagtaaacacataaatccttataaattacccaatccaactttctcatattgcatgtagagaacctgagacacatatcaaagtctagaatccttaacttctccccattttgtttttttccgcctcatcacaccatgctgcctttccctcatatgatcaccaaccagtagctgagttcaaaaactacatatttcttgggcagtcctctactggtatgtgatgccaacttttatttctttcgaagataattgccttctttgcctagccaagcagccaattttattggagaaaagcaagttatatgttcacaaaatggaaggctttctacctaaatttatttcatctgtggtcctcttattctcttccattgcttttgacatacagtggaaaaacttggccaacgatgtgctctaaatatagtgcttgtgttgggttaacttttccattaatttctcaacatcaattattcaggcccctacagttgtggtattgaggcccctaaaggcttctgcctttcaccaattagtgctgccagttactgaggcttctcccaaaaggtatcagtccagtcttaaagatatttcattgtgaaagaagaaactaaactatcaggcctcttttacaaaatgagagattgaatttaagcttgtcaagcacgtactggaaggtatgaattacactaccatgtgttttgtatcttccctttcaagtgatgatgttaaatgaaggtaagtttttcatccttttttaatttttgttttttataaatcatttcagctttttctggtttatagaggtgtcttatttctaatgcaacagacccccaactttaacagatttgatatggatgcatttattcacaagcaaccccaaaagtccaaaaatgtaataattttgacaaggcccaaagttgagatgctatgaagcttgtgtgtgtgaaaagtcagttatgattgtctggagagaagctgtggtgtgtatgctgtagagtttccacatttcacatgcagtgtactccaaaaagcgggtttgggtcaaccatttcccatctctttttaagaagtgactgctgttggggccaggggacatcatgggaggtggggctgtccagttagctgtgccctgcaccttcagcccaggaaagatttgaacagagcaaaggcttcaagagagggcagaatgtattcggcagaaaagggactcaggtaagcccagcctgggatgagagcagaaaagcattcaagatttgcaggccttgctatggatgcgcttaatcaccatggaggccagcaatacccatctcagcatggctttgatattctctacttcctggcctttaaaaatgacctataatttttcagtttgctttactatattttataaagaaaattctatcttatggttgattgagcattgagacttatgaaggcattaggatagatagctcaggaatgtaaaggttcagaaaaggtctgttttctcagattaacaaatatgatggattccatggctgaccttggtgcttaaaccaggaggtttcaatctagtcctagagttgtgtccctctgaaaggcccaatgccatgtaactaactttaaactggatatatactttgagccttacttaattcacagataagttgacttaactcagtatttttatttcaattaatgaaaacagtcctcttttcaaccccaggttgcttacattttgctggtctccccaagtgaccattggtggagaccaattaatgaaggaatgaaattcactttattgggactgtggtattcaacagagccacacttaaccactttttccaatgaagaatctccagaatgataatgcccaaatatggatggccaagaagaatttgtatctacggtgtgctttatgtgtttttgacactgctgtattctgtgtgatcaagtgatttgcagctggttccaatgtgactgagtgttctcaaagatttctagtaactaagtcaacttaattttcttaagcctggtattactatcagcctcacatttaccactttgattctagttttttaactgttcataacagggcataccgagggttgggatgagagcctacttcctacctcttaaggcactttcctcattattttgccatataatcttgaactgcatgataagctgtttaaatgtccatgacttctcccagagcaactagcaaagtatatgacattttgaatagagattagtggaaaggaaaatgtagagatttaagttcagaggtacaaacctcaataaaacctccttagagcacataccatgagtagagtatatgtaaacgtatatgagaagagagtcgctataatagtcctctctaagtagattagttcattgtctaatggaagtgaacatctttactcctgttatcaccatagtactgaatgaactgtataatgagtttttcaaacaagtatttaaaatagaactttcacgtacaaagcaagggcataaagattttggtttgtgtttctgtaagtgtagtttaccatctaaagctttggtttttaattttaaaaaaagcttcaaggtattgccattccttagcatccttattgattatgggtgatgagtttttaactcttaaaatcatatacgtgtattagtttatcttaactgttgccctaagcaaaagggaaggtatacacctaagggatgtacttattttgcatttttggtcatgggtgggaatggggtgggtgcctacttaaatagtttttaaaaaagaaaaaaatcacaaatatttttctactgttatatatgatcttcctttatactagtttctctctagtaaggcatgccagaagcccaagataccatatcatgaattcttacatattgtaccttttgttggtggttaaatcgcatcagatgcttggcattgctgccataattataaaatgcttgtaaaggatcaaatatcactaaatactttaaattgttttacttaagagtctaatctgggaagttttcaaatcatactattaatgtgtaatctaagctcttcagatgtatccatgaataatcctggaacaatattgcttgtattcctgtcatagaacaggttttgtaatctttaaaagaaatgaaaatttatataataaagtttcaaatcaatgcaaaaaaaaaaaaaa

SEQ ID NO: 260 - DNA, 60 bp, Homo sapiens
gtcctgatgatacaccagaggaaatattggcacgaataggtagcggaaaattctcactca

SEQ ID NO: 261 - DNA, 970 bp, Homo sapiens
ctcccctcaccccggtccaggatgcccagtccccacgacacctcccacttcccactgtggcctgggtgggctcaggggctgcccttgacctggcctagagccctcccccagctggtggtggagctggcactctctgggagggagggggctgggagggaatgagtgggaatggcaagaggccagggtttggtgggatcaggttgaggcaggtttggtttccttaaaatgccaagttgggggccagtggggcccacatataaatcctcaccctgggagcctggctgccttgctctccttcctgggtctgtctctgccacctggtctgccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataatattttaattgctcagtgatgttccataacccggctggctcagctggagtgctgggagatgagggcctcctggatcctgctcccttctgggctctgactctcctggaaatctctccaaggccagagctatgctttaggtctcaattttggaatttcaaacaccagcaaaaaattggaaatcgagataggttgctgacttttattttgtcaaataaagatattaaaaaaggcaaaaaaaaaa

SEQ ID NO: 262 - DNA, 60 bp, Homo sapiens
ttccaggagtatgctgttttcctggcactcatcactgtcatgtgcaatgacttcttccag

SEQ ID NO: 263 - DNA, 2633 bp, Homo sapiens
agtgggcgtggcggtgctgcccaggtgagccaccgctgcttctgcccagacacggtcgcctccacatccaggtctttgtgctcctcgcttgcctgttccttttccacgcattttccaggataactgtgactccaggcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatgtaccctttggatttcaaacagtaacatcggatgtaaacaaacttagttccttttactcactgaaactaatcaagcggctctacgtagacaaatctctgaatctttctacagagttcatcagctctacgaagagaccgtatgcaaaggaattggaaactgttgacttcaaagataaattggaagaaacgaaaggtcagatcaacaactcaattaaggatctcacagatggccactttgagaacattttagctgacaacagtgtgaacgaccagaccaaaatccttgtggttaatgctgcctactttgttggcaagtggatgaagaaattttctgaatcagaaacaaaagaatgtcctttcagagtcaacaagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagtgaagacacatctgatttctctggaatgtcagagaccaagggagtggccctatcaaatgttatccacaaagtgtgcttagaaataactgaagatggtggggattccatagaggtgccaggagcacggatcctgcagcacaaggatgaattgaatgctgaccatccctttatttacatcatcaggcacaacaaaactcgaaacatcattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagaccttttttttttttccaattctatcttttgtttccttttttcccataagacaatgacatacgcttttaatgaaaaggaatcacgttagaggaaaaatatttattcattatttgtcaaattgtccggggtagttggcagaaatacagtcttccacaaagaaaattcctataaggaagatttggaagctcttcttcccagcactatgctttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaccctataaatcaacaccttaatatgctgcaacaaaatgtagaatattcagacaaaatggatacataaagactaagtagcccataaggggtcaaaatttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatttggttggcactagactggtggcaggggcttctagctgacttgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttggttggataagctatccgtgttgcaggttcatggattacttctctataaaaaatatgtatttaccaaaaattttgtgacattccttctcccatctcttccttgacctgcattgtaaataggttcttcttgttctgagattcaatattgaatttttcctatgctattgacaataaaatattattgaactaca

SEQ ID NO: 264 - DNA, 60 bp, Homo sapiens
tataagtaaagtgattaaagtgctcacgttaccttgacacatagtttttcagtctatggg

SEQ ID NO: 265 - DNA, 3390 bp, Homo sapiens
caagccagagcaatcgaacggttctgagtcatctgccggaagccttgccctcaatcaaggcggacgtgaagcatctacaaaggaggaatagtcaaagcagcagcggcggcggcggcggcggcagcagcagcagcagcaggagaccttctctgatggatgacctctgtgaagcaaatggcacttttgccatcagcttatttaaaatattgggggaagaggacaactcaagaaacgtattcttctctcccatgagcatctcctctgccctggccatggtcttcatgggggcaaagggaagcactgcagcccagatgtcccaggcactttgtttatacaaagacggagatattcaccgaggtttccagtcacttctcagtgaagttaacagaactggcactcagtacttgcttagaactgccaacagactctttggagaaaagacgtgtgatttccttccagactttaaagaatactgtcagaagttctatcaggcagagctggaggagttgtcctttgctgaagacactgaagagtgcaggaagcatataaatgactgggtggcagagaagactgaaggtaagatttcagaggtactggatgctgggacagtcgatcccctgacaaagctggtccttgtgaatgccatttatttcaagggaaagtggaatgagcaatttgacagaaagtacacaaggggaatgctctttaaaaccaacgaggaaaaaaagacagtgcagatgatgtttaaggaagctaagtttaaaatggggtatgcggatgaggtacacacccaggtcctggagctgccctatgtggaagaggagctgagcatggtcattctgcttcccgatgacaacacggacctcgccgtggtggaaaaagcacttacatatgagaaattcaaagcctggacaaattcagaaaagttgacaaaaagtaaggttcaagttttccttcccagattaaagctggaggagagttatgacttggagcctttccttcgaagattaggaatgatcgatgcttttgacgaagccaaggcagacttttctggaatgtcaactgagaagaatgtgcctctgtccaaggttgcccacaagtgcttcgtggaggtcaatgaggaaggcacagaggctgccgcagccactgctgtggtcaggaattcccggtgcagcagaatggagccaagattctgtgcagaccacccttttcttttcttcatcaggcaccacaaaaccaactgcatcttgttctgtggcaggttctcttctccgtaaagaggagcaattgctgtacataccctcctttccttctacctatcttgccttaattaacattccctgtgacctagttggtgcagtggcttgaatgccaaaataaagcgtgtgcactggatagtgtgtgaaagtctttgctgaaagttccagagccattgagaataactgaggccgcagatgcatgaaatttgggcctgggaaggctatgctggttttggagtgtttggggtgcctgccattgcctctgccttcacctaagtctgtgcccattgtttcaggggatcttatggagcatctcagggcttcaggagccagccctcttccatccgcccggctctgcccaccaccactgccaggctgaacaggggactagtgcccaggtgacactgcacacaaagccaagggcaaaccctatagagtaaagctgcagccaccctgtgtctcatgtgcagctgaaatagtgatctgcttctgtcactgtcacatagacagccctgcatgccccctgtctcacacagtttgtaatgaagacagctccttctcatctttccataagcctgagatacaagttcagggactcagcaatgcactttaggactgagctaggaggcaaatatctgaagcttgctatgctgttctttccattccttttccctctgaaacacacaaaataccaaaggaacttacgcaacacaccactgagtcctctaactaatcatatgtgctcagacacagctcaagcacaccccttagttaagaaagaacctccatatacattaatttttttctgcctaaaaataaaattgcgttgtggcagcaatttggaaactacagcaaagtctccaaaaaaattgaagtcacccacaattccaacacacagcaatcactgctgttaatagtgatatacatccttccctattatgtgtatgcaaatagaaatttataagcattttactacaagttaatcatatccttcagtagcttatttcttcccttatgaaaaacctcccttaagatctttccaggtcatcaatttgatgtgcatagtattccactgtgtggctggatttctataattgaatctaattttagacagtttgagtaattaaaattatttctattaacaaataatagattgctaataatatatattatgctgttttggatatactaaatatttgctcacatccttaatatattttttaaaattcctaacaatagtactgttgagataaaagttgagcacattttgagacttcttccaaattggtccctagaaagttacactggtttgtactctcacttatgtcactgtttataccaccactgactgctgcctgctttattatttctttaatgagttggactgaacagtggttaatcctgactctgtttttgactgacagttaacagttacatgaaccattcatattacagctcttacttaaatttgaccaagccaggatatatctgttaggccacattcatttagggatcatgttttccaaagcaggtttgggcaaaattaatccacaggactgaaaggtatacatctgtgagttttgttctcacttccacctctaatttgaagaacactttaattgacacagaatacatttcacatatttaacctctacaataagttctgacacattttccatgaaacaaaccatcgctatattcaagataatgaacctatctatcatactcccaaattccttcttgcatctttgtaatttctcactcttccttctccctctccccgtcccatcccaaccactgatctgctcaggcaactaccaatcttctttctgtcactatagattaatttgcatttttaaagaaatttacatacatggaaccatacatcatctatgctttgtagtatgactcctgtcactcagtacaattattttgagattcatttatgttattgtatgtatcaatagttcatcccttttattggtaagtaacatttttttgtataggtataccatgatttgttgatgaacaaatttacctgttgatgaacatttacgttgttaccaagatttttgctattgaaaataaagtttttatgaatatttatatatataaaaaaaaaaaaaaaaaa

SEQ ID NO: 266 - DNA, 60 bp, Homo sapiens
ggacaaattcagaaaagttgacaaaaagtaaggttcaagttttccttcccagattaaagc

SEQ ID NO: 267 - DNA, 7248 bp, Homo sapiens
gcggccgcgggctcccgctaaccgcagcctccactcctctccccgcgcgccgcgcccccgccccgccccgcccggtctcgccggccgagcgtccgttggtccttgagcgcgtccgacagtctgtctgttcgcgatcctgccggagccccgccgccgccggcttggattctgaaaccttccttgtatccctcctgagacatctttgctgcaagatcgaggctgtcctctggtgagaaggtggtgaggcttcccgtcatattccagctctgaacagcaacatggggtgcaaagtcctgctcaacattgggcagcagatgctgcggcggaaggtggtggactgtagccgggaggagacgcggctgtctcgctgcctgaacacttttgatctggtggccctcggggtgggcagcacactgggtgctggtgtctacgtcctggctggagctgtggcccgtgagaatgcaggccctgccattgtcatctccttcctgatcgctgcgctggcctcagtgctggctggcctgtgctatggcgagtttggtgctcgggtccccaagacgggctcagcttacctctacagctatgtcaccgttggagagctctgggccttcatcaccggctggaacttaatcctctcctacatcatcggtacttcaagcgtagcgagggcctggagcgccaccttcgacgagctgataggcagacccatcggggagttctcacggacacacatgactctgaacgcccccggcgtgctggctgaaaaccccgacatattcgcagtgatcataattctcatcttgacaggacttttaactcttggtgtgaaagagtcggccatggtcaacaaaatattcacttgtattaacgtcctggtcctgggcttcataatggtgtcaggatttgtgaaaggatcggttaaaaactggcagctcacggaggaggattttgggaacacatcaggccgtctctgtttgaacaatgacacaaaagaagggaagcccggtgttggtggattcatgcccttcgggttctctggtgtcctgtcgggggcagcgacttgcttctatgccttcgtgggctttgactgcatcgccaccacaggtgaagaggtgaagaacccacagaaggccatccccgtggggatcgtggcgtccctcttgatctgcttcatcgcctactttggggtgtcggctgccctcacgctcatgatgccctacttctgcctggacaataacagccccctgcccgacgcctttaagcacgtgggctgggaaggtgccaagtacgcagtggccgtgggctccctctgcgctctttccgccagtcttctaggttccatgtttcccatgcctcgggttatctatgccatggctgaggatggactgctatttaaattcttagccaacgtcaatgataggaccaaaacaccaataatcgccacattagcctcgggtgccgttgctgctgtgatggccttcctctttgacctgaaggacttggtggacctcatgtccattggcactctcctggcttactcgttggtggctgcctgtgtgttggtcttacggtaccagccagagcagcctaacctggtataccagatggccagtacttccgacgagttagatccagcagaccaaaatgaattggcaagcaccaatgattcccagctggggtttttaccagaggcagagatgttctctttgaaaaccatactctcacccaaaaacatggagccttccaaaatctctgggctaattgtgaacatttcaaccagccttatagctgttctcatcatcaccttctgcattgtgaccgtgcttggaagggaggctctcaccaaaggggcgctgtgggcagtctttctgctcgcagggtctgccctcctctgtgccgtggtcacgggcgtcatctggaggcagcccgagagcaagaccaagctctcatttaaggttcccttcctgccagtgctccccatcctgagcatcttcgtgaacgtctatctcatgatgcagctggaccagggcacctgggtccggtttgctgtgtggatgctgataggcttcatcatctactttggctatggcctgtggcacagcgaggaggcgtccctggatgccgaccaagcaaggactcctgacggcaacttggaccagtgcaagtgacgcacagccccgccccccggaggtggcagcagccccgagggacgcccccagaggaccgggaggcaccccaccctccccaccagtgcaacagaaaccacctgcgtccacaccctcactgcagccaaaggtgcaattacttgacctgcagccccagcccaccctcggctctgcagccggttctccgggccctggtcacctccagacagctgcctggccggggccactaggctgcggctggccactgtgtctcctcacttctctgaacaaagcagttcctcccctaccagctcagccccgagctgccgcagcctcaggcagaacggaggtcaccttctctccttatcttgggaaccaggccttcctcccggggactgttctgggattgaaattgtgcatactccaaactttcgcagccatcttcccgctcagccccagacacccagcaatcaagccagatgagtaccacaaaacagtgtgtccccagcagctccccaccccagagccaaatgacagtagtgcacttaaaaaggaaaatcaggcctgttgtccttctccggttgcattcagatgggtcattagggccggaccctgcctgccccttggcttctcagggctttgctctgacaccatgacagctgcccggggctgagggcagctggctccactcaaatgaggaagaagggatcactcccattagggcctgctttgcttatgcatgtgtgtgcacatgcatgtaaaccagggaccttcagctcacggcctccaggcctgggccagttcttgctgctcctgccgtctcccccgactggctgtgtcctgagtaactggaacatgagacagtatctgcaggactggccccatggtggccgagtcagaagtctgtttcctgtgagtcgccaccgttcactcagtcttgccctcccatgctttggagccagtctggtggctcctgtaaggttctcaaggctggtggcagctcagtctggggtcaggacatgtcggggtcatgcgtttctggccctgacataagctgtctggcctctctgtgacatgatgaaattgaaatcaatccacagtccatgaaattgtgacactccaccagattaagttagggcataacattaacttggaaatggccatgtcatcacccctgcggctgtcctatagctgagatgcgtgggtcgcaggggaggtgatttctaggcatattgctgtcccttttgtgtatctgtcatccggatgcttcggaccccacgcctctgcaagtgggagagacccgagcatcctccccacccccatagctccagtgcacgccacccccgtcttgcctgggtcggggcctgcggccagcaccatttcacacacactccttgtagatgggagccagaggaaacctgaacgtgggtggagcgttccactgagtctacttcaggagacagaaggcccatgctgatgggggaggaggagggacgtgggcattttggacaccaggggaaatggaaatgctgctttcaaaacttagtttcctttccatttcttcctagtctggcctttgacacaaatctggtagaaagaagcctgataaattgagggcacttgtaccctccctgtgcccccagaaggttcttggagagaagtgcaagaatttgtgaacacggcggtggagggcgggtggatggccatgggctgggcctccgtatcaggcctgctcaccttgctgggagctttattctgatctcattttgaatgttccagagggagcatcataagagcccagagctccgatttccaaagagtgatattgacatttatggagattggtgttgtaacatattttgataaatactaacttattttgttggggttttggttgtctcttgtcttaggacctggtagttatttgcttgatttttttttccgttattttctacataggcaaagagaattcgagggatagacagtctccaagaaaagtgaagtggtgggagagaattgcttttttcttttttttcttttctctagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagaagcacgcctaggctgggcagggatgggacccatgccccctccttagaggacgggcttcctggttaggaaaggacacgtgggggtgccttgcataatagttcactggtcaccgtgcttttatgagtagtgtttttgtgcacttgccaggggttttctctctgtgtgagaggggagtgatttaagcaatggtgtctggagtaagccttacaattttaatagactttttcttatcatatccctcatttctttccctgaaataaaaatacacacaagcaaaaaaaaaatgatagtttcacatctcttagttcccttgcccaaacaagaatattcttagttccactggccaggattttcctacatagtcagaacttacacattactagaggcacacccaccaaggagtattgtgtctacttttatctgtgcaccagccacaaatacccacattggaaagacccatttgtgatgggtaaacatcccttcctgtctcccacaacccctgtgactgccctgcatgtgttcatgacctccgaaggcccaaattcatgaagcagcaaacccagcagatctccacccccctgcctcaggacctctgctgaagagggggatgaagtgggtctccagggaggcagtgggggccttgttggcagctggctcgggagccggcttacaggagggcagctctgcagttgggaggggcaccgtccggaggagaccaggcctctacacaccccccactctacttatcatccctgctcacacacccttgtccaaggctttatgcatcggatttatttttccaaatcaagaggacagtgatagatgcattttccccaggctgtctcagaaaggtcgctaaatgtatactgttgtcagaattgctgagatctccccccacttttggtttttgcagcagtaaaaactctttccactgtgacttattttctctctcaggcagccagccacctggtcccttgtgctgactctagcacagtggccaggatccaatacgagtccaggggtgaccgcaggatggtgggggcagcgggcttctccacctaccccagccaccaaggccctgacgcactgcctcctgcaccttcagcacatccctgtgcacagctggaagggtgcatggcccgctcacctttgttcagatgggtggaaacgctgatgataccagctcctccctgccgtgcccctgccacggagcaggcattgtgaactggctggtgtttgcagtcccacgtggcatggcctccagcccaacccacagtggagactggagacagggcaatgagtctggtcgggggcacgtggacatgccccataggggccccacccagacttaacaggcaaggtcctgggcattgcgcgacgcaggactcaatgctaaagcaagcctgcctggctctgtgccagggcccctcttctgatttacacatcccatttttacacagacccttccttcttaataaaggctgacagttctgttggcagccaagaacccacaccatgaagacagggagtgaggggcctttgtgcccaactccagcacagctgcgttctggggtgtgtgagaggcatgttcgtgtctgtgcgctggtggtctcgtgagacagttccgaggacggggaaattgcagggtggtgggggcgtgaggcttatatgtggaactgatgcagagttcgcctgcagacggatctggatatacactatgtataattgttacgtgtaatttaaaatatatctgtttgccatcgtcatgagaagattatatgtaaggctctgaagggagagggagatgtacattctgccaggctcctggggaccttatccgagtcatgaaattgatgactgttgatccagtggtgcaagaagctacactccatgtgtcatcacgcttatgactcctaatgtatttttaaggcaaaaaatgtcagccgactccatcttcacccctcgattcctcgagtccagcctttctgtgccagtgcttcactgagccacaacgctctcgccatcgggacccggctgggcctggagtctcggggcacagttgccatggagccctcctgggtcattctacaaatgtgctgagtgccagctgaaaaccccacaggagatggagtaccttggccaagcttaaagagaagattttctcagggtatttattagtgtgtccagcagggtcaggaagcaggatggaaagatgcattcagactgttaatttattaacaaggcaaatgattttgtgtttcttgatgacagactattaagtttgggacttattttcccatttgagaagttataatatatatttaagatgataagtttcctgcttaagttgtgcctttcagcttcaatgagtttaaggagcactaagggtaatgataccaatgagggttggtttattatcaaacctgaatagctgtggtttctccagtaaatattttcttctactgaacatggagccattattaagagttgtgtgttttttattatgtacatttgtatatttttttgcttgtttgatgttctatttttctaatagttttcttttagtttcttaaagttgtgatactagatttagattctgatgctaactgcaaatcaggttggtctctgctgggtctctcctgcttttattttactttaaggacaagtgtagttgtcgtccaccacctttcaaaaaatgtgaaactgccctgcctcccctttttgctgacaacactgtgtacattgaccacttcctaccatactttatgttgtaaaatcaaactcttttgtggtacattatctcatgcttctgcaaattcgaataaattctatggcttccaaaaaaaaaaaaaaa

SEQ ID NO: 268 - DNA, 60 bp, Homo sapiens
ccaaaatctctgggctaattgtgaacatttcaaccagccttatagctgttctcatcatca

SEQ ID NO: 269 - DNA, 2580 bp, Homo sapiens
ggtatggcccggccggagttaaggccggggggaggcggcgagtcccgcggcggcggcgacgatggggctgcgtgcaggaggaacgctgggcagggccggcgcgggtcggggggcgcccgaggggcccgggccgagcggcggcgcgcagggcggcagcatccactcgggccgcatcgccgcggtgcacaacgtgccgctgagcgtgctcatccggccgctgccgtccgtgttggaccccgccaaggtgcagagcctcgtggacacgatccgggaggacccagacagcgtgccccccatcgatgtcctctggatcaaaggggcccagggaggtgactacttctactcctttgggggctgccaccgctacgcggcctaccagcaactgcagcgagagaccatccccgccaagcttgtccagtccactctctcagacctaagggtgtacctgggagcatccacaccagacttgcagtagcagcctccttggcacctgctgccaccttcaagagcccagaagacacacctggcctccagcaggctgggccatgcagaagggatagcaggggtgcattctctttgcacctggcgagagggtctgactctgggcacccctctcaccagctacaaggccttggactcactgtacagtgtgggagccccagttcccacctctgtgacaataggatcatggccttacccttgaagcattaccgagaaggagaacagagatgggcttgaagagccacgtgctgccggctccaaattcccaaggacaaggatccctctgcatttttgtctatgtaacctcttatatggactacattcagctgcaaggaaaggaaaaccttgattgcagtggtttaaacaaacagaagattgtttttccacatagcatggattctggagatgggtggctaatggtattggttcaacaactccacgaaggtaggggtcacgtcttggatccttttgccttaatctcagtgctcgttacttcatggtcccaagatggctgctgtatccccaagaatcatgtctgcgttcaaggaaggaggggtggaggaagaggaagggccaaactagctggacccgtcaccttctatcagaaagtaaaacctcgtcagaagtctgtttcctgctctctccctctgcatatcttcacttagatgcccttggcccgagccagctaccattgcacctctagctgcaaacaaagctaagacagcagggaacagaattgtcatggctgaatagaccaatcgtgttccatctactgagactggcacactgcctcctgcaataaaactgggatcccattaccaagagagaaatgcagaattgtgtaccagttagcttttgctgtgtaacaaaccatccccaaacttggcagctagaaacaaaccctgtattttcccacaatcctatgggttggcaatttgggctgggctcaacagggcagttctgctgctcacacctgggatccctcatggagctaaggtcagctgttacctcagctgggcctggatggtctaggatagccttactcacttgcctggcaggtgacaggctgttggctggaattgcttggttctcctccatgtggcctctccagcaggctagctcaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtggccatttttcacctatcacaaataattttggatgggtatttatttggataaaggtatttccctcttccccctttctctctgtctcatggggcctcactctgccaagttggaaggcactaagacattgtcctggccctcagggtctaggggaagaggtgttggggcaggaagtgagtctctccatgggctggacccactgtagtaggagtgcctccttgtctgcactgctggtatggggttaggccaggtaggacattccagaggggcttctgaaaaccaagagtccctggggaaagggaacagagtaaggcaggccttgttctcactgccctctaagggaacttggtcactcggcacttttaagcctcagtttctccagttcaataataaggacaagagcttttcccatgcattctctttccccgggaaagttgactgaggtgaccagtaatagaattgaaaagggagagtgtcttcagtgcaatgtggcatcctggattgggtcttggaacaaaaacaggacattagtgggaaaattggaaatctgaaaaaagtctgaattttagttaatataccaatttcagtctcttggttttgacagatgtaccatggtgatgtaagatgttgaccttggggtaggctgggtgaagggtatacaggaactctttgtactatctctgcaacttctctgtaaatctagtatcattccaaaataaaagtttatttaatttaaaaaaaaaaaaaaaaa

SEQ ID NO: 270 - DNA, 60 bp, Homo sapiens
tttccccgggaaagttgactgaggtgaccagtaatagaattgaaaagggagagtgtcttc

SEQ ID NO: 271 - DNA, 1295 bp, Homo sapiens
ggagttcccgagtatcgcgagaagcgcgcttagtctgcacgccgaggtccgcgctgtgtcccgtgttttctgcgtgagaggaaaagatgctagaaccacaggagaatggcgtgattgacctaccagattatgagcatgtagaagatgaaacttttcctcctttcccacctccagcctctccagagagacaagatggtgaaggaactgagcctgatgaagagtcaggaaatggagcacctgttcctgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaaactgcagtttgaggattttattgacagagttgaatacctgggaagtaaaaaggaagttcagacctgtttaaaacgaattcgacttgatctccctattttacatgaagattttgttagcaataatgatgaagttgcggagaataatgaacatgatgtcacttctactgaattagatccctttctgacaaacttatctgaaagtgagatgtttgcttctgagttaagtagaagcctaacagaagagcaacaacaaagaattgagagaaataaacaactggccttggaaagaaggcaggcaaagctgctgagtaatagtcagaccctaggaaatgatatgttaatgaatacacccagggcacacacggttgaagaggttaatactgatgaggatcaaaaggaggagtcaaatggattaaacgaagacattctggacaatccatgtaatgatgctattgccaatactttaaatgaagaggaaacactgctggaccagtcttttaaaaatgtgcaacagcaacttgatgctacatccagaaatattactgaagctagataagtttccattaagagaaaatgtatctgttaagtcatcgtcctgcaagcttggcgttactatgtattttttcttcttggagtgaaaatccttagatagtaaaactgttatagattattgtttaaaatctgataatctggtatttatttataattatgcttgtcactttagttaaatctatttgttctctttagtgtttgtttttatataggtatttcttcataaaatgattaggaggtaataagcagtttctgctgctggtctgtcattgaatgccttgttttcactaagaaaaaaaaaaaaaaa

SEQ ID NO: 272 - DNA, 60 bp, Homo sapiens
atgaacatgatgtcacttctactgaattagatccctttctgacaaacttatctgaaagtg

SEQ ID NO: 273 - DNA, 4408 bp, Homo sapiens
agtcgcgggggcggcggggggggggcggaggctccgtggaaatgtgtcggtgacattgaatggggagaccgagcgcgagcgaggcgcgcgcgcgcacacgcgcactcacggccccgctcgctccgagatccccggccacgtaagtaactattaataccgcctcgccgggggatgcgggcgtgctgagcgcggggattggcctcgggcaccgtcggccgtcccctttaatttttaaatacacggtcccctcttttctctggggggggcaagcaagaaatcaaagaaggaggagacaagccgtcaattttctccaaaacaaaccccaccgggcaatttggtctcggggtagggggagacggggtgattgcaaattattccaggacgagatccagttctccagcgggaaaggggcaaaggaacgccgcgcgttggaagggccagggacgcagctccccttgcagcgcccgcaggacccccgcaagctcgtgccggcgaaatcggagaccgccgatctgtcctcgttctctcctgcacgtctggctgcattcggaggaagacctggggcgcgagcgagcggcgacagcatgagcctgtgctgacctccgcgcggcgggccgagcccagggctttgtcgcggtacctgcgcccagcccgcgccgcaactctgtgcccagcttttgcaatcttttgttggcagcgctgaccgcaccaagttaaatgctcccttgcaatttttcttttttttgtttgtttgtttaatttttggagagctcgcgatcttggaaaagcctcagacgccatctacagttaaaacgtaggtaactgccctctcccgcaccccccccttacacgccccccaccctttccaccaaaaaaagggggtgcagcgcggattctggctgccgtgcgtcgccagccggtagacccgtgcttgtttcctttctctttttgtttggcttctaacgcgttgggactgagtcgccgccgtgagctccccgaagactgcacaaactaccgcgggctcctccgccccgtctgcgattcggaagccggcctgggggtcgcgtcgggagccctggcgctgcagctccgcaccttagcagcccgggtactcatccagatccacgccggggacacacacacagagtaactaaaagtgcggcgattctgcacatcgccgactgctttggggtaacaaaaagacccgagttgcctgccgaccgaggacccccgggagccgggctcggagcagacgaggtatccggcggcgcccatttgggggcttctaactctttctccacgcagcccctcttctgtcccctcccctctcgctcccttttaaaatcagtggcaccgaggcgcctgcagccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttattgttggaacctctggagggagaccacgtttttcgtgccgtgcatctgcacagcggagaggagctggtgtgcaaggtgtttgatatcagctgctaccaggaatccctggcaccgtgcttttgcctgtctgctcatagtaacatcaaccaaatcactgaaattatcctgggtgagaccaaagcctatgtgttctttgagcgaagctatggggacatgcattccttcgtccgcacctgcaagaagctgagagaggaggaggcagccagactgttctaccagattgcctcggcagtggcccactgccatgacggggggctggtgctgcgggacctcaagctgcggaaattcatctttaaggacgaagagaggactcgggtcaagctggaaagcctggaagacgcctacattctgcggggagatgatgattccctctccgacaagcatggctgcccggcttacgtaagcccagagatcttgaacaccagtggcagctactcgggcaaagcagccgacgtgtggagcctgggggtgatgctgtacaccatgttggtggggcggtaccctttccatgacattgaacccagctccctcttcagcaagatccggcgtggccagttcaacattccagagactctgtcgcccaaggccaagtgcctcatccgaagcattctgcgtcgggagccctcagagcggctgacctcgcaggaaattctggaccatccttggttttctacagattttagcgtctcgaattcagcatatggtgctaaggaagtgtctgaccagctggtgccggacgtcaacatggaagagaacttggaccctttctttaactgagctcatgccccacggagacttagcaggttccaggagtgagcgagggcagcggaaaggagttcttccgggggacacgaattgcctggctgagtagcaagaaagacacactcttaagtttcttggttcagagcaggaaaaccttcaaggagctgactgaccacgtagcatgggggcaagaggcgtgggatggggattggggtgagatggatgggagcccgctggagcttgtcttccctaacatagcctgggagaccaccccttgccacttgggccacttccgcctaccccacttttcattttgttccaaaatagttgcagatcctgacagaatcaaaactctctgcctcaaacacacatcctggcatcgcactgttagcatttaacttcttgttaggattcagggaaggaacagttggccaagaattttttttcttttaaacaagccaaccacctagctggtaattaatgaggttcacttaaaaaaaaaattcggtgcacacagactgacatgaaacctgggtgctacagtaaaagaaaacaaaagtccagtttgtgtctcttaatcgctcacttcaactcatttcttctaaataaactatttaatatcctggtcaggaaatgacatgttaatgctttgctccctgaagggggaaaaaatctgtcctttaacaagctattctgttttgtgtcaattggttcgtggcaggaagctattagaagtcaaacgtccagatgcattactgctatcttagtttaaagggggaaagaaaagggaagaagaaaggaaaagagaaatccaactcctttttcatgttttgcttttgaacaatgagggtttgtgtgacaggcattcctctttgctgagatgatagcaatggcctgagattttagcaagctcctggagtctgatgcttttgcagtactctgatcgcaactaaacatttgtctttgttttattagaaactagtgaaacaaagcaggttgtcccacatgtataaaatacagggcagctatttagttttctttacagagaatgatccttttaaggcttgtaaggccctctggtttggacaaaaaccctcagtagagacaagcgggaaggataattagctgaaagctatgatgatataaataaaaacagctctctatcccaatacgcacctttgtattttcaagaactcttctatttattaaggaaaatgtcacattgtgatgtattaagccagtacttcaattacgggttgacttgggatgacatattacatgctgtagttaacatttataattctttttccttgtttgagtatttctgtctctgaaataaccttttacttggcttttctagatagctttatttgatttcgagtggcaaaatgttttttattacggcttttctattgctgtatgatacagaactcttttggcataaatatttgtgttcccagtacctcacttgttcggatttgactgcctgtatatgttttgtgaaatggtcctgtttttgggtaggtgacacgtggactctagtatgtaaatgttacttgaatctgtgcttcataatagtgtgtggcatgtatgtgcagactcttggatgctttatgcctgcgcagcaggagccctgtcctcacgttcccaggagggcggcttcacccttcgtaaccaggagacaaggcggccatggatttgcccttgattctattttgctaatggaagatagaaaggagagaaggttttttttttttttaacattctgaagatggtgctgtgtcaagaaggaccttttttttcccctctcccctattttttaagtaccttggaggaggagaggttggtgacatgcatggtggggatctatggcctctggtgctttgtcctgtatttggtttaatgtttttgtcctaatctcttcaatcaataaaattgtgcgtatttaactaaaa

SEQ ID NO: 274 - DNA, 60 bp, Homo sapiens
ggcctctggtgctttgtcctgtatttggtttaatgtttttgtcctaatctcttcaatcaa

SEQ ID NO: 275 - DNA, 1736 bp, Homo sapiens
cgaccctcagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatcttgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagatacccttaaaaaaaaaaaaaaaaaaaaaaaaa

SEQ ID NO: 276 - DNA, 60 bp, Homo sapiens
tttttactggtttgtgtttatattttcggggatacttaataaatctattgctgtcagata

SEQ ID NO: 277 - DNA, 2318 bp, Homo sapiens
cgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggttccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactccccgctgaccctaacaatacctttggagctcgctttacctctggctacttcatctccgaccctggctcccctttgagccctaatttatctttaacccccttgagctcttccaaccttgacattcccaggaggagccccgcttcaccccttctgactctggaaaccgcacctttaactttgcagaccttccttcacccctgacttctgcttcacctttgacctctgccccccatgaatcccattttacctctagacctataagttctggtttatgtttgacccctccctctgagctgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctgattcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatggaaaaaaaaaaaaaaaaaaaaaaaaaaaaaaaa

SEQ ID NO: 278 - DNA, 60 bp, Homo sapiens
tgtccatgaaggaggtggacgagcagatgctgagcgtgcagagcaagaacagcagctact

SEQ ID NO: 279 - DNA, 1645 bp, Homo sapiens
gcgggctggcgtgcggcgccgttgcgggcgggagcggctgcaacgccggtgcctgaggagcgatgccgagggaaatcatcaccctacagttgggccagtgcggcaatcagattgggttcgagttctggaaacagctgtgcgccgagcatggtatcagccccgagggcatcgtggaggagttcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggagaaaagatccatgaggacatttttgacatcatagaccgggaggcagatggtagtgacagtctagagggctttgtgctgtgtcactccattgctggggggacaggctctggactgggttcctacctcttagaacggctgaatgacaggtatcctaagaagctggtgcagacatactcagtgtttcccaaccaggacgagatgagcgatgtggtggtccagccttacaattcactcctcacactcaagaggctgacgcagaatgcagactgtgtggtggtgctggacaacacagccctgaaccggattgccacagaccgcctgcacatccagaacccatccttctcccagatcaaccagctggtgtctaccatcatgtcagccagcaccaccaccctgcgctaccctggctacatgaacaatgacctcatcggcctcatcgcctcgctcattcccaccccacggctccacttcctcatgaccggctacacccctctcactacggaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcttgcagaggatccgggaacgcaagttggccaacttcatcccgtggggccccgccagcatccaggtggccctgtcgaggaagtctccctacctgccctcggcccaccgggtcagcgggctcatgatggccaaccacaccagcatctcctcgctcttcgagagaacctgtcgccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcacccaggagcagtgagtcccccaggacagggaccctcatctgccttactggttggcccaagccctgcctgactgaccaccccctcagagcacagatcagggacctcacgcatctctttctcatatacatggactctctgttggcctgcaaacacatttacttctcctcttatgagactatttatctttaataaagcactggatataaaaaaaaaaaaaaaaaaaaaaaaaaaaaaaaaaaaa

SEQ ID NO: 280 - DNA, 60 bp, Homo sapiens
gcctgcaaacacatttacttctcctcttatgagactatttatctttaataaagcactggg

SEQ ID NO: 281 - DNA, 3952 bp, Homo sapiens
gggatgactcggcgacgccgccaggcgcgttacccggcgtgctccgcgcggcgccagcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaactgatgcaaaacatgttgtctgccccctacatgagaagcatgatgcagtcactaagccagaatcctgaccttgctgcacagatgatgctgaataatcccctatttgctggaaatcctcagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataatttgtggtacagtattgcttattgtgactttggcatgcatttttgcaaacaatgctgtaagatttatactactgataattttgttttatttgtatacaatatagagtatgcacatttgggactgcatttctggaaacatactgcaataggctctctgagcaaaacacctgtaactaaaaaagtgaagataagaaaatactcttaaagctgagtatttcctaattgtatagaatcttacagcatctttgacaaacatctcccagcaaaagtgccggttagtcaggtttgttgaaaatacagtagaaaagctgattctggttatctctttaaggacaattaattgtacagacacataatgtaacattgtctcaacattcattcacagattgactgtaaattaccttaatctttgtgcagactgaaggaacactgtagtataccccaaagtgcatttgcctaggacttctcagcttctcccataggtagtttaacaggcattaaaatttgtaattgaaatgttgctttcactgaaaaagtgtcttgatgtttcagttatttttaatcgccataaaaaaatagaactatcttttgggtttatctgttttctcatgcacaggcaatacacaaatttaaaatgagttgtgagccaattgtttctgaagtgttttggtagttctattaagaaatagttaaatattgtgcttttcagagcctcagagaaagggggacggggtgggggggtggggcagcggaatctgtcctggatggggccagcttaaataatactggcaaccaagattctgttaggatttctgtgcatatagtgtagtaaagaagtatcattcaggggtgaaaaacaaagagccgttttaatgatgttgagtacatttggctgttttatagcctttttcttccctcccccaaagaattctgtttgcctaactcccaaactgttggggtggtacattcctttaggaccaattaaaacataattgagggtcagtgatacatttggctgactctggttcagtattctcttaggtgattatattctctcatgtacagttacaggaaattaaaatgttaaagtaacctaaaatgaattcagaccaataaaatcaagggaaatacaagttgattgcattacttctgtatgttgcttgctattaaaaaggttaagaggccaggttacccaccagtccttgcactgttctgacactttccccaggaggaaaacaagtacaaaggttacggtggaggcataagtagaagagattgttaagaagggtattcatgtgtctttgctctttctgctttatgcctcagtttggtttaaaaacttctgtactggcaaatggtggtattcagtgtgggatagtgtcataactaatttgacaatttattaatcataaaataacaataaatctctagcttttacacttg

SEQ ID NO: 282 - DNA, 60 bp, Homo sapiens
caggctcttgctggagtaaatcctcagctacagaatccagaagtcagatttcagcaacaa

SEQ ID NO: 283 - DNA, 1170 bp, Homo sapiens
gtgtggccagggcatgacgggcaatgcggtggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggttcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagggaaaataggataaaagaacaaggtgtgagaaggaatagaaggaaacaaacaggaaagatatggctgcaccatgcagtgctactatatgctgagattctacaggatgagatttttgaatagctgagcagttgcctataatctgtgatgacataaaagtatttgacctaaaatctttttatttgcaaaataataaataaaaagtgattctccctcg

SEQ ID NO: 284 - DNA, 60 bp, Homo sapiens
gagatttttgaatagctgagcagttgcctataatctgtgatgacataaaagtatttgacc

SEQ ID NO: 285 - DNA, 1362 bp, Homo sapiens
aaaaccttgaggtgattcatcttccaggctctccttccatcaagtctctcctccctagcgctctgggtccttaatggcagcagccgccgctaccaagatccttctgtgcctcccgcttctgctcctgctgtccggctggtcccgggctgggcgagccgaccctcactctctttgctatgacatcaccgtcatccctaagttcagacctggaccacggtggtgtgcggttcaaggccaggtggatgaaaagacttttcttcactatgactgtggcaacaagacagtcacacctgtcagtcccctggggaagaaactaaatgtcacaacggcctggaaagcacagaacccagtactgagagaggtggtggacatacttacagagcaactgcgtgacattcagctggagaattacacacccaaggaacccctcaccctgcaggccaggatgtcttgtgagcagaaagctgaaggacacagcagtggatcttggcagttcagtttcgatgggcagatcttcctcctctttgactcagagaagagaatgtggacaacggttcatcctggagccagaaagatgaaagaaaagtgggagaatgacaaggttgtggccatgtccttccattacttctcaatgggagactgtataggatggcttgaggacttcttgatgggcatggacagcaccctggagccaagtgcaggagcaccactcgccatgtcctcaggcacaacccaactcagggccacagccaccaccctcatcctttgctgcctcctcatcatcctcccctgcttcatcctccctggcatctgaggagagtcctttagagtgacaggttaaagctgataccaaaaggctcctgtgagcacggtcttgatcaaactcgcccttctgtctggccagctgcccacgacctacggtgtatgtccagtggcctccagcagatcatgatgacatcatggacccaatagctcattcactgccttgattccttttgccaacaattttaccagcagttatacctaacatattatgcaattttctcttggtgctacctgatggaattcctgcacttaaagttctggctgactaaacaagatatatcattttctttcttctctttttgtttggaaaatcaagtacttctttgaatgatgatctctttcttgcaaatgatattgtcagtaaaataatcacgttagacttcagacctctggggattctttccgtgtcctgaaagagaatttttaaattatttaataagaaaaaatttatattaatgattgtttcctttagtaatttattgttctgtactgatatttaaataaagagttctatttcccaaaaaaaaaaaaaaaaaa

SEQ ID NO: 286 - DNA, 60 bp, Homo sapiens
cagtaaaataatcacgttagacttcagacctctggggattctttccgtgtcctgaaagag

SEQ ID NO: 287 - DNA, 2155 bp, Homo sapiens
gcgtcaccgaccggtgcggacaggaagaggctctgggctggcacatgtgtatggcggtgaggcgggcgggtacatggcgggctctgtgggactggcgttgtgcgggcagacgttggtggtgcggggcggcagccgattcctggccacctccatagcaagcagtgatgatgacagcctcttcatctatgactgcagtgctgcagaaaagaagtcacaagaaaataaaggggaggacgcgcccttggaccaggggagcggtgcgattctggcgtccaccttctccaagtctggcagctattttgctttaaccgatgacagtaagcgtctgattcttttccgtacaaaaccatggcaatgtctgagtgtcaggaccgtggcaaggaggtgtacagccctgactttcatagcctcggaggagaaggtcttggtggccgacaagtctggagacgtctactccttttcggtgctggagccacacgggtgtggccgtctagagctggggcacctgtctatgctgttagatgtggctgtgagtcctgatgaccgcttcatcctcactgccgaccgggacgagaagatccgagtcagctgggccgcggcgccccatagcatcgagtccttctgcttggggcacacagagtttgtgagccgtatctccgtggtgccaactcagcccgggctgcttctgtcctcctctggggacggcaccctgaggctctgggagtacaggagcggccgccagctgcactgctgtcacctggccagtctgcaggagctggtggacccccaggccccccagaagtttgccgcgtccaggattgcattctggtgccaggagaactgcgtggcgctcctgtgcgacggcactcctgtggtctacatcttccagctggacgcccgcagacagcagttggtgtacaggcagcagctggcgttccagcaccaagtgtgggacgtggctttcgaggagacccaggggctgtgggtgctccaggactgccaggaagcccccctggtgctctacaggcctgtgggcgaccagtggcagtctgttcctgagagcaccgtgttaaagaaagtctctggtgttcttcgtgggaactgggccatgctggaaggctctgccggcgcagacgccagcttcagcagtctctacaaggccacgttcgacaacgtgacctcctacctgaagaagaaagaggagagactgcagcagcagctagagaagaagcagcggcgccggagtcccccgcctgggcccgacgggcatgccaagaagatgagaccgggggaggcgacgctaagttgctgatcgtggcggtcagtggtgtctctcacctcaaattaggaaaagctttttaacttgttcccctgcatcctggcatgtcccttcaagaaggaaaaggtgacatcagttgtgaccagctcagaggatggggctgtcccctgggctctagaaagaacattctgtgtcaccagcacaggctcttgctgggtgcctgtgccccctttctggttgaagggaagccagaccagtggagtggaagctcttgaagcactttcttttcatgtcggaggctgcgtgtgagccggtggtggcggcagctgtctgtgtttctcctgttctcataccgcccttcgtgtccgctgcatcttcctctaggagcatctgtgggctgacgtttctggcatggtggatgttttcatgttgttccgccgtctcagcatccaggtgacgtgctgtcccgcagtagctgctcgccacacaggctgttgaaactcagcacgaatgcttgagcctgccccagccccagccgtagcccttgtgctcaggagctgctcctggagagtggctcccttgtgggaagtgagaaacacgtttcggagtcgcagggagctctgtctggcatcggtggcacagatggtgaacttgtttcaggaagtgtgagcacgggcctggctggcacccggtttacagggaggtgattgaggacgtcgttatgatttgatttgaccttggcacacactgcagagccacagggatgttgctgaatttcaatcaccgatcagcaaggatgaaccttctcaacttcctaggaatgtttagcagcaacctaatataccaggcaaaactcaaaaaaaaaaaaaaaaaaaa

SEQ ID NO: 288 - DNA, 60 bp, Homo sapiens
atttcaatcaccgatcagcaaggatgaaccttctcaacttcctaggaatgtttagcagca

SEQ ID NO: 289 - DNA, 5851 bp, Homo sapiens
cttgcgcggtgtggcggccgatgccgctataaaggcttgttttgctgcagggctcatgctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccagccttcatggtgaaacacctcttggagtatacccaggcaacagagtctaacctgcagtacagcttgttgttagtgctgggcctcctcctgacggaaatcgtgcggtcttggtcgcttgcactgacttgggcattgaattaccgaaccggtgtccgcttgcggggggccatcctaaccatggcatttaagaagatccttaagttaaagaacattaaagagaaatccctgggtgagctcatcaacatttgctccaacgatgggcagagaatgtttgaggcagcagccgttggcagcctgctggctggaggacccgttgttgccatcttaggcatgatttataatgtaattattctgggaccaacaggcttcctgggatcagctgtttttatcctcttttacccagcaatgatgtttgcatcacggctcacagcatatttcaggagaaaatgcgtggccgccacggatgaacgtgtccagaagatgaatgaagttcttacttacattaaatttatcaaaatgtatgcctgggtcaaagcattttctcagagtgttcaaaaaatccgcgaggaggagcgtcggatattggaaaaagctgggtacttccagagcatcactgtgggtgtggctcccattgtggtggtgattgccagcgtggtgaccttctctgttcatatgaccctgggcttcgatctgacagcagcacaggctttcacagtggtgacagtcttcaattccatgacttttgctttgaaagtaacaccgttttcagtaaagtccctctcagaagcctcagtggctgttgacagatttaagagtttgtttctaatggaagaggttcacatgataaagaacaaaccagccagtcctcacatcaagatagagatgaaaaatgccaccttggcatgggactcctcccactccagtatccagaactcgcccaagctgacccccaaaatgaaaaaagacaagagggcttccaggggcaagaaagagaaggtgaggcagctgcagcgcactgagcatcaggcggtgctggcagagcagaaaggccacctcctcctggacagtgacgagcggcccagtcccgaagaggaagaaggcaagcacatccacctgggccacctgcgcttacagaggacactgcacagcatcgatctggagatccaagagggtaaactggttggaatctgtggcagtgtgggaagtggaaaaacctctctcatttcagccattttaggccagatgacgcttctagagggcagcattgcaatcagtggaaccttcgcttatgtggcccagcaggcctggatcctcaatgctactctgagagacaacatcctgtttgggaaggaatatgatgaagaaagatacaactctgtgctgaacagctgctgcctgaggcctgacctggccattcttcccagcagcgacctgacggagattggagagcgaggagccaacctgagcggtgggcagcgccagaggatcagccttgcccgggccttgtatagtgacaggagcatctacatcctggacgaccccctcagtgccttagatgcccatgtgggcaaccacatcttcaatagtgctatccggaaacatctcaagtccaagacagttctgtttgttacccaccagttacagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtgtctacatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagggtcctgattcgggagctgaagcgtctggacaatatcacgcagtcacctttcctctcccacatcacgtccagcatacagggccttgccaccatccacgcctacaataaagggcaggagtttctgcacagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctgactcctccctgttgacgaagtctcttttctttagagcattgccattccctgcctggggcgggcccctcatcgcgtcctcctaccgaaaccttgcctttctcgattttatctttcgcacagcagttccggattggcttgtgtgtttcacttttagggagagtcatattttgattattgtatttattccatattcatgtaaacaaaatttagtttttgttcttaattgcactctaaaaggttcagggaaccgttattataattgtatcagaggcctataatgaagctttatacgtgtagctatatctatatataattctgtacatagcctatatttacagtgaaaatgtaagctgtttattttatattaaaataagcactgtgctaataacagtgcatattcctttctatcatttttgtacagtttgctgtactagagatctggttttgctattagactgtaggaagagtagcatttcattcttctctagctggtggtttcacggtgccaggttttctgggtgtccaaaggaagacgtgtggcaatagtgggccctccgacagccccctctgccgcctccccacggccgctccaggggtggctggagacgggtgggcggctggagaccatgcagagcgccgtgagttctcagggctcctgccttctgtcctggtgtcacttactgtttctgtcaggagagcagcggggcgaagcccaggccccttttcactccctccatcaagaatggggatcacagagacattcctccgagccggggagtttctttcctgccttcttctttttgctgttgtttctaaacaagaatcagtctatccacagagagtcccactgcctcaggttcctatggctggccactgcacagagctctccagctccaagacctgttggttccaagccctggagccaactgctgctttttgaggtggcactttttcatttgcctattcccacacctccacagttcagtggcagggctcaggatttcgtgggtctgttttcctttctcaccgcagtcgtcgcacagtctctctctctctctcccctcaaagtctgcaactttaagcagctcttgctaatcagtgtctcacactggcgtagaagtttttgtactgtaaagagacctacctcaggttgctggttgctgtgtggtttggtgtgttcccgcaaaccccctttgtgctgtggggctggtagctcaggtgggcgtggtcactgctgtcatcaattgaatggtcagcgttgcatgtcgtgaccaactagacattctgtcgccttagcatgtttgctgaacaccttgtggaagcaaaaatctgaaaatgtgaataaaattattttggattttgtaaaaaaaaaa

SEQ ID NO: 290 - DNA, 60 bp, Homo sapiens
tcgccttagcatgtttgctgaacaccttgtggaagcaaaaatctgaaaatgtgaataaaa

SEQ ID NO: 291 - DNA, 1956 bp, Homo sapiens
ctctctccagctccagctggacctgaagtctcagagctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcacctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgatcgagcggatcatcaccccgcgcctggcgctgaccactgctgaattccttgcctaccagtgtgagaagcatgtgctggtcatactgacggacatgagttcctatgcagaggccttgcgggaggtctctgctgctagagaggaggtgcctgggcgccgagggtttcctggatatatgtacacagacctggccaccatctacgagcgggcgggccgcgtggagggtcggggaggatccatcacacagatccccatcctcaccatgcccaacgacgatatcacccaccctatcccagacttgacgggcttcatcacagagggacagatctacgtggacagacagcttcacaacagacagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagatgaatttaaaaaaaaaaaaaaaaaa

SEQ ID NO: 292 - DNA, 60 bp, Homo sapiens
catgcctactctgacgggagcatctgtattttttatgttaaaagcccacaaaataaaaat

SEQ ID NO: 293 - DNA, 2678 bp, Homo sapiens
ggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaa

SEQ ID NO: 294 - DNA, 60 bp, Homo sapiens
ctactttcctgatgttgataatagtaatggttctagaaggatgaacagttctcccttcaa

SEQ ID NO: 295 - DNA, 2813 bp, Homo sapiens
ctccaccgacagccaggcactgggcagcacgcactggagacccaggaccctgtgcaggagcagctccgggtgacacgaggggactgaagatactcccacaggggctcagcaggagcaatgggtaaccaaatgagtgttccccaaagagttgaagaccaagagaatgaaccagaagcagagacttaccaggacaacgcgtctgctctgaacggggttccagtggtggtgtcgacccacacagttcagcacttagaggaagtcgacttgggaataagtgtcaagacggataatgtggccacttcttcccccgagacaacggagataagtgctgttgcggatgccaacggaaagaatcttgggaaagaggccaaacccgaggcaccagctgctaaatctcgttttttcttgatgctctctcggcctgtaccaggacgtaccggagaccaagccgcagattcatcccttggatcagtgaagcttgatgtcagctccaataaagctccagcgaacaaagacccaagtgagagctggacacttccggtggcagctggaccggggcaggacacagataaaaccccagggcacgccccggcccaagacaaggtcctctctgccgccagggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacgggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagtcagttaaagaggactcagtccccacaggtgcggaggagaatgtggtgtgtgagtcaccagtagagattataaagtccaaggaagtagaatcagccttacaaacagtggacctcaacgaaggagatgctgcacctgaacccacagaagcgaaactcaaaagagaagaaagcaaaccaagaacctctctgatggcgtttctcagacaaatgtcagtgaaaggggatggagggatcacccactcagaagaaataaatgggaaagactccagctgccaaacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaacccaagtaaacaaatcagcacggttcccaccaggttctcctgccaccaagatgtgttctccttactccatctcctccccaaacacgctccatgtatatattcttctgatggccagcaaatgaaattctgcctagaaattaagcccgagctgttgtatattgaggtgtattatttacgtctctggtccagtcttttctggcaaataacagtaaagatggtttagcaggtcacctagttgggtcagaagagtcgatgatcaccaagcaggaaagggagggaatagaggaatgtgttcgggttaagtgatgaaaatggcagtggtggccgggcgtggtggctctcgcctgtaatctcagcactttgggaggccgaggcaggtggatcacctgaggtcaggagttcaagactagcctggccaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctgggcgacagagcaagattctatcaaaaaaaaaaggcagtggcaagtaagttatagaagagaaatgctgctagaaggaattaagcgttgtagtaaacgcgtgctcatcctctaagcttgaagaagggagacgaaaatccatttgtttaaattcacatctcaaggagggagaacccgggctgtgttgggtggttgccaatttcctagaacggaatgtgtggggtatagaaaaaggaatgaataagcgttgtttttcaaatagggtccttgtaagttattgatgagagggaaaagattgactggggagggcttaaaatgatttgggaaaacaattgcttttgaggctcagtgacaacggcaaagattacaactt

SEQ ID NO: 296 - DNA, 60 bp, Homo sapiens
aaaggaatgaataagcgttgtttttcaaatagggtccttgtaagttattgatgagaggga

SEQ ID NO: 297 - DNA, 4919 bp, Homo sapiens
acttcgctccgcgcagccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaagacaggagcccagcacccatgagttgtgacaaatcaacacaaaccccaagtcctccttgccaggccttcaaccactatctcagtgcaatggcttccatgaggcaggctgaacctgcagatatgcgcccagagatatggatcgcccaagagttgcggcgtattggagacgagtttaacgcttactatgcaaggagggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctcagaggattatgtaacccctgcagtggaaactgagccagctaacttaaaaagctgccttagtttatttttagagattacagaatttttaaacagggagacgtgtgatatactccctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcagaacaagagttaatatctgcctgtatcttgcacagttcgagcgatctgttattaactgggaagcatttggtgttggttttcattccatttcgacgagcatgttattgggaagtattctgaagaggcaatagcagtaataacaacagacttaagtgctacgcccctttgtgctgctggcttttctggttgcaggctttcccatggtcacaggatgcactgtcagcatcaggtcccagagggccaccgtgtccattacagcagagtccagctgcagcatccagctcacgccctcatgggaattggcacaggcctggggcagggcttctgatggccatttgcttggcctcctgcattttagtccaactcacagtccactagcttcactcctttaaattcactttgaaacaggcctcatcccacttccaccagcaccatagaagaataattctgggcagaagtctgttttttttcatttttccaggacagttggatattgtcaggccacttgtgaccccagccatgtagtgagggtgctctttctctgtgcctgctccttatgagtgcagtggaaggaagccacacactggtcagtcatttcagaggcagcagatgcccagggagacccaagaaagagtcaggttagggagcagtgaaagtgaggagggaagacaattctgtgaactctgtaactcttaaaatttttgaaaactccatcgttaaacaacttttaaaagaaataactaaattttcaaatgagtaagcagtgccaccaactagtgttttgcccgatagaagagccagcatgttcacgttatttaaattaggtggaaaaatctaaacatttttatcttcataatttaaaaaatatatatgtatatattgcatattcactttttcctttaggtagagatgatttcaatccaaatactcttactttaaaaaatttcctttccccaagaatctccttgggactttgacttatttttaaagctgtgttggagctcatcttgttccctgatgtgtctcgagcccattggtagggtcatacaaagcccacggttacaagcagtggtaggattgcagccgtgggcctgctggacacacacatacaccaaagatgtatttggatctgggcaccccctcccaggatccctgtactcacgtgccagtctcctgactagagcactttactctgtttcctcagccctgcagcccctgggagcacacactgggtgcagccctgggccaggcacgggaggccctgccctgtgctgcccaggggctgtgtgcaccacatgagcacatttccctctggcctggcggcctccaggctggctgtggaaacagttcctgaggaaattagagattctatgaattgtaggagtattaaagaccaggctgttggcaccagaacttaaagcgatgactggatgtctctgtactgtatgtatctggttatcaagatgcctctgtgcagaaagtatgcctcccgtgggtatacgtttttaccttttttaaaaaacatttttgtagaaaaaataattaaatcccctttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgtttttctcaactttttcaaaatcaaggattgtaaatattgtagattctttttctgtgtgatgtgtcctactgtttcataatgctgtaacttgtagaaatattgtatatttattttctgcttatttaatgtcttaatttctgaaaagtattaacatccctgtctcccactcccctgccgtcccatgaagttaactcctgagagttgtcgggggtgactggagagctcattgcagaccacgtggtcctccagggtggctctccaccttcgggtcctggtatttccagtcaagtgggtttcaattcttgggctttgccgcccttatgatgaagtgtgtgtttgatgccagtgagaaactcagtctggcaggctacaaaattctactccaagaaatacccagcaaccttctgtttgttccaaagcaactagcttatcatgcaagcaaattttgctgactccaggctttatctttaggaaaacaaaaaaaccaaagtattatcagcaggtgggaaagatttttctattgaaaatttatccctgacaactcagcgtttagaaaagaaataaaatgtgccacttccagaggtgctgcattgcagttgttcagggctagggccaggcaggacaagtgaatgggtgggacaggtggctcctgcctaaggaccacctcaggccactaaccccttgtggacaactgtgagtagctgggttttcccccacctgctgtgcaacttcctgtgctttgaggttggactaacttgtcttcaggagctaattaactgtacagccctccccacgccccacccatacggtcactgcatttggtcagcctgcttcttcaggtcgatgccctccttctgatactccatctccttcaggggaggttggggccccactggactgggtgtcaagatgtgaaagcttatgggagctttaaggagacttcatggtggttccatgcaggtggttctgccatccctgctgatttagcctggtgcctgtgtgtgtccactcacgtacacgtggggtgggggaaacgtgtctacagatgacgctaaatcagttggggtctactctaaacagcattgtgtgtaagaagcatcctcaagctcccagttaagtaacttgactacttttatttgggaatttcagactatagaagctctcttatgttttatgtccagattctgtgaccactagttactgtatcagaactcatcaggtacccacttataaatagcactgatctggctgtatactgatccatcactaacctgttttctaggacccagcgtatgtagcatttgtattgcagtttccctggcttacttgtgttttgcactgatgaattttgacagggtaattgccactttacttgtgcaatactgctgtaaataactgcagatttttaaacaatcttttatgttaattttataaaaataaaactttcaactagtt

SEQ ID NO: 298 - DNA, 60 bp, Homo sapiens
gacgagtttaacgcttactatgcaaggagggtatttttgaataattaccaagcagccgaa

SEQ ID NO: 299 - DNA, 1054 bp, Homo sapiens
attcaagcctgggccctggaaggaggggtggacagtcccctcccttccagtccagcatgggtctggggaagaggagcagctttgcctggaaggggcctcctaggagggggagcggtggtttctagctcaggctttaggatcagagagcagcagattcaaatcctgacggttttggtaaagtcaattcaatctctccaagactccgtttacttgatctgcgaagtggggataatggtatcacgtcgcagggttgtcaggcggagctggtaggggagctgccccccagagcagcatggatgccccgcgaagggacatggagttgctcagcaacagcctggctgcctacgcgcacatccgcgccaaccccgagagctttggcctctacttcgtgctgggcgtctgcttcggcctgctgctcaccctctgcctgctcgtcatcagcatctcgtgggcgccccgcccgcggccccggggcccggctcagcgccgggacccccgcagcagcaccctggagcccgaggacgacgacgaggacgaggaggacacggtgactcggctgggccccgacgacacgctgccgggccccgagctgtccgcagagccggacgggcccctcaacgtcaacgtcttcacgtcggcggaggagctggagcgggcgcagcggctggaggagcgcgaacggatcctgcgggagatctggcgcaccgggcagccggacctgctgggcacaggcacgctggggcccagccccacggccacgggcaccctgggccgcatgcactattactgatgggccctggctcccgccgcaaggcgctcggggtaccggacctgtacatgagctcagagctaccccacaccttcggactgcctcggcccccacagctcccaggtgctactgggcgtggaccgccaccccctgagaggctcccttccccagtcctgccagaagaccccgggggcggggagggggcagcatgcagggtccccactccctctctggggtcgatgaagaggtgaagtgaccaaatgaaagaaagctgcattctcagtg

SEQ ID NO: 300 - DNA, 60 bp, Homo sapiens
cctctctggggtcgatgaagaggtgaagtgaccaaatgaaagaaagctgcattctcagtg

SEQ ID NO: 301 - DNA, 3066 bp, Homo sapiens
gggtcagctccgcccaccctccccggcctccgcccgcctcccgggtcagcggcgcgggtgctgcgcctagctgcgcaccatggccgggttgctggcgttgctgggtccggcaggcagggtgggcgcccgggtccggcctcgcgccacctggctcctgggcgccaccgccccctgcgccccgccgcccctggccctggccctgctcccgcccaggctagacgcccggctgctccgcacggcgcgcggggactgccgcggccaccaggaccccagccaggccacggggacaacaggcagcagcgtcagctgcacagaggagaaaaagcaaagcaagtcacagcaactgaaaaagatttttcaagagtatggcactgttggcgtgtcattgcacattggaatctcattaatttccttgggcatattttacatggttgtgtcaagtggtgtggacatgcctgcaatcctgctgaaactcggatttaaagagtccctggtacagtcaaaaatggcagcaggcacaagtaccttcgtggtggcctatgcaatccacaagctgtttgcgccagtgagaatcagcattacgctagtctctgtgcccttgattgtcagatattttcgaaaagtgggattttttaaacctccagctgcaaaaccttaatgaactcttcagtcgtacacactgaaaacctatttcttctaaattacatgatttggattggttttagggttttagggttgtagggtttcttttggagaggtagggggctaattgctatgttctcatggataaactttgccagcaaaaatcaggcttttgaacaattttaattttttgcctcataaattttgtgaatgctattcattatagggcttgtatatataatctaaaatgtcagcaaggcatcggagatgggttaacatctcaaaacaaaatagcctacaaatgttccttgtgggagactttggcgagggtctgtgggtaaaagcaccagggggttaatcttggctcagtttcctaaaaagcattgattaatttaactggcttttaaatatccccttccgctgatatttgttgtcagctgcctacagtttaatatgcagcgttcacaaaacagctgccagtgctacaattaatgaagcaaaacttaatatgtaatcacaatctaaattagcatcaatactttgacattcattacattggtttgggggaagaaaagtagttctggtatgtttcattgatccccagataccttccaatctggacatgatggggctgattccagatggtttttctgaaatttcattaaggtaggtcagcgtcatttgtctctgtttaggtaaaatataaaaaccctgcccagtagcagtggcatcgcttggttcctgatgcccatgttccagaggaattcggataccacaaacagctaagacaatctcagcttttcttagacaatcttctatctcaaacttcagacattccagaattgtcatgatgtttacactgtctgagttaaaaatcctgttcaagaaaaaaaaagattttgtatcacttcttaaaaaggaatattcatagcacttgtcacaaatagaaggcaaccatgagataatacaagccagggagaggcttgtattacatgacaggtgtaattagtctgctgagccagctttacccaatgaagggcatatgtgttagagagattagctaagagtagaaattcgagcatagaggccaggtgcggtggctcacgcctgtaatcccagcactttgggaggttgaggcaggcgtgtcacttgaggccaggagttcgagaccagcctggccaacatgatgaaaccccgtctctactacaaatacaaaaattagccgggtgtggtggcacacgcctgtagtcccagctactggggaggctgaggcagcattgcttgaacccaggaggtggaggttgcagtgagccaagatcacaccactgcactccagcctgggcgacagagggagacactgtctccaaaagaaagaaatcccagcgtagatccaaactgagacactgaggcttcgtccttatagtagtcaggagcaggcgattgaagtaattctgtcctgcggggttcagcatcatgcacgttccccctgggccattctctgatgcagggcacttgctccacactctgggaacccagattcaccagtctgccctgtcacgtagttgaaggagttgcatttatctttctggctcctaattcctttaaaattacatttgttgcagaacctccacaaggctaaataaaattacatttgtgaccatcagagaactgaataaaccattaactggccatcctggttttgcagagatcaggttgttgacagttcctggttgacccacagctacccatgtcagttatctccactaacatatccaagaatctttgtaggacaatttctccacctgcaaggtctttcaggtagaactcttcttttaaggcaattagcccattgccaaaaggttttactgtcttaaagctgtctttctgagatctaattccaaggacttctccacagctaagtgagatgcctcacaccattaggtgatgctttggacagaacagagtattttcatcttgtgtttaaagcaattccttggcttcggctcctcaccactttctatgccagtctcccatttatgtccctagtaatgcctatgcaaaaaaaaaaaaagaaaaaaaagaaaaactgatggtgaaacctacaggtttaagggcttaaatctcaaactttgttaggagtaacaggagcgtgctgagcgggcaagcaataaaacaaatcataccaaaaagccacattgctctctcctaagccccaaccccactccactcctgtggccaggggtccaaacagaaaataaccggagaagacaaggaggtcaaaggatcagggaactaagcattatgtgaattcaccagcaagatgtacagaacgcctgtgtttacattgtttttatggaactagcagaataaaacatctattttaaaaatgaaaaaaaaaaaaaaaaaaaaaaaaaaaaaaaaaaa

SEQ ID NO: 302 - DNA, 60 bp, Homo sapiens
caagatgtacagaacgcctgtgtttacattgtttttatggaactagcagaataaaacatc

SEQ ID NO: 303 - DNA, 3855 bp, Homo sapiens
agaaggagccagcatggacaatctcctttacagtttcggaagcaggtttgttgccatggagttcacattttgacgggagttgagaagtataaaggtaaccatttgttttagtttcaacgatctgacaaaaagataggctgttgctcttcttctggaaaagcctgattggtaagattcctttaagggctcagccccaaagagctttatcccatcccctcgcagactgaaaactaaagcctgcagagacctctgaaggaaaacctgtcccgggctctgtcacttcacacccatggctaaccctggaggtggtgctgtttgcaacgggaaacttcacaatcacaagaaacagagcaatggctcacaaagcagaaactgcacaaagaatggaatagtgaaggaagcccagcaaaatgggaagccacatttttatgataagctcattgttgaatcgtttgaggaagcaccccttcatgttatggttttcacttacatgggatatggaattggaaccctgtttggctatctcagagactttttaagaaactggggaatagaaaaatgcaacgcagctgtggaacgaaaagaacaaaaagattttgtgccactgtatcaagactttgaaaatttttatacaagaaacctttacatgcgaatcagagacaactggaaccggcccatctgcagtgccccagggcctctgtttgatttgatggagagggtatcagacgactataactggacgtttaggtttactggaagagtcatcaaagatgtcatcaacatgggctcctataacttccttggtcttgcagccaagtatgatgagtctatgaggacaataaaggatgttttagaggtgtatggcacaggcgtggccagcaccaggcatgaaatgggcaccttggataagcacaaggagttggaggaccttgtggctaagttcctgaatgtggaagcagctatggtctttgggatgggattcgcaactaactcaatgaatatcccagcattagttggaaagggatgcctcattttaagtgatgagttaaaccacacatcgcttgtgcttggggcccgactctcaggtgcaaccataagaatcttcaaacacaacaacacacaaagcctagagaagctcctgagagatgctgtcatctatggccagcctcgaacccgcagagcttggaaaaagattctcatcctggtggagggtgtctacagcatggaaggttccatcgtgcatctgccccagatcatagctctaaagaagaaatacaaggcttacctctacatagatgaagctcacagtattggggccgtgggcccaaccggccggggtgtcacggagttctttggactagaccctcatgaagttgatgtgctcatgggcacattcaccaaaagttttggagcttcaggaggttacatagctggaaggaaggacctcgtggattatttacgggttcactcgcatagtgctgtttatgcttcatccatgagcccaccgatagcagagcaaatcatcagatcactaaaacttatcatgggactggatgggaccactcaagggctgcagagagtacagcaacttgcgaaaaacacaagatacttcagacaaagactgcaggaaatgggattcattatctatggcaatgagaatgcttctgttgttcctctgcttctttatatgcctggtaaagtagcggcttttgcaaggcatatgctagagaaaaaaattggagtggtggtcgtgggatttccagccactcccctcgcagaagctcgggctcggttttgtgtttcagcggcacatacccgggagatgttagacacggttttagaagctcttgatgaaatgggtgatctcttgcaactgaaatattcccggcacaagaagtcagcacgtcctgagctctatgatgagacgagctttgaactcgaagattaagtttcctggtcctgaatgacacataaagactttgcgagaaagacctccctccttgcctcacaaggaatataaatggatttctcccccttcctcaggacaattttggttcccagaccagcttgattgaactgagggagacgttgttgtttttaatgtctccagcttggactgcagagacaaaaacatgattccagatttaagtctctcttcttccaagtattctactagaaatacacacacacacacacacacacttctgagaatatttttaatggcaataagcctgtgttttagctgctactgtgcagaccctttcagggattccaaccaaatgcaaatgagagaatttaaaatttttattcagtaagttcactatgtgtttacttattccatctgcagatgtaagtgagtgtggtggacagtagccaccttccttgttccactcataaaagcatcagctagatctcatctgtatcatgggaagttccaggcaggagggtaaagaaatgttgtttctaccatttgtcacatttggacgtttttcacagacaagtgtcaaaagacatagttaatgtttcgagggggaaagcagaactgatcaactgcgactagagacgtctttgaaggaaattttccttttcctcttgctggtctcctacagttttacagctgagcttttgaggtttggaaaattcaagatgtttgtttcataagaaaaggggcagaaagcaagcacaagacacttttaggtctagactaaaatggtagttacaacaatttgaaccttgttggtgcagtgcacggtgaatgcttaccctgcacagcctctattaccttaaggaattagttgtcattttcctattgaattttgagtaaatggtgaaattcagtgtcctttagaatcgactcccaagactatatttgaagaatgcattgattcaagaaggacatttaaaagcaaattctgactttttcaagaccaacacacttgtttaggcctattaaattgtactatcacttgttacatgccctctgaattgggagaaagtgggcttgcacactttgaggtaactaactgtaatttacttgtgttctctctttcttgctctccttctcaacatgaacacaaacctctatggaaaagtagcctcttgttaatctgatctagtttgtatggaaaaagcccatggagaaccttatctttaacaagctcccagagggtgcccagatttggaaattctagagagcagtggtgaccttttagcaaagcttctgtaacagttcgaatgagttgcagaacattccactccatcaaatgacactgtaaacaaatcacttcaagagaggcttggttttgtgtggcacagatggacccaagctttcatgctgtgcactgagatagaaactccacccgcagcgcctgcgatggatggagcagtgtgccctgatgctcaaagcgtattaaaggaaaaaaagtgatcagcatggaaagtttttatggggaaattataactccaagtgggtgcattggtttaaaaatggatcacaatgatagagttcttcatgaatgtttacaagttgtaaggaataccgttagtgaaagaggaaaagaagtgggttctgaaaatgcagtttcccatccaatgattttgataacaaaattccaacttttctcaatgaaactgatgcagtattatttgtgcaaataaaatgtgtcataaatatgcaaagaaagggagacatactgttcttatcttgaatatgtgcatttaaatgaattgtccaaaatgcataaatgccttgcgttctataaaggaaacaggaggtcaaaaagacagcgagatatctagtccttccacaaggtatggaaagcaataaacatcttcctttctttctgaaaaaaaaaa

SEQ ID NO: 304 - DNA, 60 bp, Homo sapiens
cctggaaaacagagcttctttaaagcataaatcacgtgggacctattaaaaaacacacac

SEQ ID NO: 305 - DNA, 1222 bp, Homo sapiens
gcttttagagcactgtgatgtaacatgtcaagcagaaatagggagcatgtttacagccattctatgaaaaagtgttcggaatgtacagactagcacagaagctggactaattgaacaagtattgctgaaaatgagtgctgtagatgacatgatagcagagtaccttcaagtttaaatctgagagtgatattcatttggcagaacatcataaacaggttttgtatgatgggaaacttgcaagtagcattacctttacatatactgctaaggccactgatgctcaactctgcctggaatcatcaccaaaagagaatgcatcaatttttgtgcattcccaacatgctctaatgcttcagattcaagtgctttttccactgtttccccaattggataatcggcagctcaatgacagtcaagtggaaacaactgtctgctcctgcttcaggtgcagaaatacagcgatttccagtgccagctgttgagccagtgccagcaccaggggcagattcccctccagggacagcgctggagctagaggaagctccagagccctcctgccgctgccctgggactgcccaggaccagcccagtgaggagctgcctgacttcatggcacctcctgtagagccaccggcctcagccctggagctgaaagtgtggctggagctagaggtggcagagaggggtggccagcacagctccagccagcagctcccacactgctcccagtcctgggcacagtggaagctatggaggcagagaccagggtttgcaatctgggctcctctgcctcactggagagggacttctctcattcagcagagcagcagccctgctgctgaagggcctgctgctactgctgctggggctgtttgcctgcctgcaggaggtgctggagagcaagaaaaggagcctgtgagcaggggttccagcaggtcctcctgctcccagaggcgacctcctcctccaggcatggaggtttgccctcagctgggcatctgggccatttgcccctaacgtgctgcccaggatggcctcctcttgacaggcggacagggggtgagggggccagggggcatctccaaaggaagcttttaaactcagcagctgcaccccagaatctgtatgcctgcacctgcccaaggatttattcatagcttacctaagaatttcaaatttctaccataacactgaataaagtttgactttttgaaacttcaaa

SEQ ID NO: 306 - DNA, 60 bp, Homo sapiens
tgcacctgcccaaggatttattcatagcttacctaagaatttcaaatttctaccataaca

SEQ ID NO: 307 - DNA, 3051 bp, Homo sapiens
aaggaagtttgcctctggtaccaccttgggactaagtgtatacccaactaagtcccttcatctccctggaccctgccttcaatcatccctcctcttgcaggtctccaacatgctaccggtgatagtgggcccattagtaatgggctcccacttgtcctccatcaccatgtggttttccttggccctcatcatcaccaccatctcccactgtggctaccaccttcccttcctgccttcgcctgaattccacgactaccaccatctcaagtaaggaccttctccccacaatgggtccctaggcaacaaccatcaccctccctccttaagcttctgatagcaggcactggtatctcagtttacatgtgagtgctagttggggaagaggtctgatggctgggaaaataaccacactgggatgaccttactcttttccttctgaaattgggtcctcctccaactgggggttttaaacctatatttggactctgggccctttgaataagctctggacattctctttagaaaagtacatatatgcataaaactcctgcaggcaatcacaagtaagtcatgtatctctgaaagccccagactttttcaagtgtagtctacaaacctcctataccagaatcacctgagatgcttgtttaaaatataggctcttgaattccactccaaatatgctgaactaaggtatctgggggagcagggcctggaaacctgcattttagttaagtgttccaggggattctgatgctggtgatctcatacctgaagaagcctagttctgctagagattctcagactgtgggcatcaatcacatagcaagcttttcaaaggaggactccagatacggcaaattgcaggtttggagtggcccccgggagatgcattggtagcaactccccagcttattctgatgcagatggtcaggatggtggtgacaggtgtggggtaggagggctgagaaatgtgtgaggctggcacaaatgaaatgggatctgcacggaagcctccagcatgggcactgcagtgccgtcctctctcttctaggttcaaccagtgctatggggtgctgggtgtgctggaccacctccatgggactgacaccatgttcaagcagaccaaggcctacgagagacatgtcctcctgctgggcttcaccccgctctctgagagcatcccagactccccaaagaggatggagtgagagacagcctaagtgtcatcctggctgtccctcagccatgggatgcagacacggcttcctgattgcacctaacaatttgcctccttcggccacacgccctaatgatggcaccaccagggtagagggaaggtcggcttcccggaaaagcagggccaaggatgaggctttcttcaaactactgcccttgatgtccctcaatgggatcaggagttagcttaagaaaaaggaaaacacagctccccagactggaggctggtcagagggaggagacccctggtcctctgctgtggaaggagaggggttcagccccagataactcctttgtggcctgggcaggatgcagagaatgacaaggctgaaaggagggggactggaggctgcctggctccagcgagagctccttctgggaccagagggtgggacggccaggtatcactttgccccttcctgccccaaaaggctttcacatacccgactcaggccagagccaagacaccctggcaaatcattataggtctcaattcatgacataccagatgccagtcgccacttcacccaacacacacacaaacatacacacaccaaacactctgagtgagtggtaaaggccccgtttttactctggcccaccgcaaacaaaaggtttccctctgtgggggagaaaaagaaatccaggagctcctccctggattaaaaccaacgaggtgcagaccaaactttaacacctttagccttatgtggaaaccaaaaaccaactgctgggaaactgtgaaaagcccttttacccacaaggggaggggtcaaagttgctgccctttggggacacccgagacccctaattagcctatctgaatgaggaccaaaggttagagccctctttctccccgaagaaagagcccggaaaaacatggcagagcaaagagcaaaatcctttctcccccgaatgctttaccagtttctcagcaacatttattcaagatgatttttaccaggaaccttatcaaaggcaaaaccacagctgcttgggttgaagtccccatcctggcctcctctcagccgccagacatggccaggaaccctgtggttcccaagaacaatttaaagatcactctttgatttgaaagaccaccattatcattttactaaattcttatatatacttgtgccttttccaactttcagttctcttaagaaaaacatccactgtagctttataaaataccttagtatcagctaggtccaagtctccaggcaggactatcaaaatggactccttcttcctatcagctctagaaccccagaggacttgcccagtaggccagctgagcacttaccaggcagcatctccctggccttccacagtctcgcctgtctgtctctggccttggtggacctggctccctccctaggaggcttttgccctcagcttgaatacagttcctggtgcatcaaagctgtaagttctcagctgctggcctgcactcatcacctcttcctacaaataaacatttggaaaaaagtccatcttcaatatgcttaaagagaagggtaggagataaggagaaagaacagatacggtttttttcccctttaaggcctttagattttgaggtactgtaaggggcctagaaggacaaaaggctttcattccctcttccttttggcaggcaggttatcagtccttggcagaagggcccagccctatccttttctgtatcaaacaaaatccttgaggttggtatacaagttaaggctgaaaaaaggccttaaattcccagtaaagaatgtgaaagcaagcatgtaaaataaactggtcttcatgaaaaaaaaaaaaaaaaaa

SEQ ID NO: 308 - DNA, 60 bp, Homo sapiens
atcaaacaaaatccttgaggttggtatacaagttaaggctgaaaaaaggccttaaattcc

SEQ ID NO: 309 - DNA, 4590 bp, Homo sapiens
gtcacttaagtccagcaatgatctccttggagaaatcaaaagatcctccctaagagacggccttggagggcatcgcccctggggctgggcacagcacgtcttcccggccccggcgcgggaggagggtttggggacagcggccgcactccggacccttcttcagattgcacaggaggaggcggtagcggaacctttctcctccgcctggttctcgcttccacccgggcccagttggggacggacgcactagaggcgacctaaacatggagacagcgggcgctgcaactgggcagccggcctctgggctggaggctccggggtccacgaatgaccggcttttcctggttaaaggtggaattttccttggtaccgttgctgcagcgggaatgctagctggatttattacaacattatcattggctaaaaagaaaagccctgaatggttcaataagggaagtatggccacggctgcattaccggaaagcgggtcttcccttgccttgcgagctctgggctggggctccctgtatgcatggtgtggggttggtgtgattagcttcgcagtctggaaagctttaggagttcacagtatgaacgactttcgaagtaaaatgcaatcaatatttccaacaattcccaagaactccgaatcggctgttgagtgggaggaaacattgaaatccaaatgagatgagcatggatgaatttcaaaatgcttgttacagaaaggggtggctctggagacaccatgacagcaaaaggactgggactgatttctcccaggaacatgggcagattgctgactgaaccagtgcactggatagcattcagcctcatcacaggagagtatgtgtgtgcgtgctgggggagggtaaagttttcccacagttaagaagactatttaaaaatagtaattacaggaataacttccttatgtggaggggaccccataggaaatgattctgtttgtaacagttgaagcaaatttcatactaaaaaagtttataataaaagtatgataagaaaatatttataaaacagaccccctaatagcaatagtactgcaatgtgtctaattaaaggagtttcaagagcctttcttgtcaatatatgacagaacttggaagtcttattctgattagccagactacaaagtgacagtcacctggtaagtcctgtatggtaggaagtgggtgtggctctcgggtcctaaatgtggtctgtgctttacagccatcacacacatgctagttatttacctgatgcccttgcttgaaggccctataaattcttatacttaaaacaaaaagccagtaatgagttgtgatcaccccaaaaggcacagttgggctaaaataatgatgatatcaggggtaaacatatttttttgagaagttggtctggatctctgaacactgacaatttgtcattttgtctcagttgtcaaagtaaaaaaagcccagttgtcatccgtcttcaatatttttaaccagaaagtcacctgagtacggagtcccaatataaagtatttgggaccacctccctaacaaagctgttagggtaaattctgtgtgcacgcccaactccctcctgtcttccacagtctcctacaaaaaaaacagatggagaataatgtctacatgcaattgtttttactgcaattgtattttaaaatattttcaagaagagaaatactttaatatgtcaatatgtccagagaaaaaacctgtagttaaatatcagttgtgcaatttcttcctacttgcctaggctctaattagtcagcaatcaggtttaataaaggacatttgaaatttctgttatcatgaaaccttttattctaagggagatttttaaatgaaatgacaagaacttaatgtaatacttttctctagaccatgttaccctgttaaaattgctgtattgttaatgaaacaggtgtaatcagcatctggaattcatatgtaatctgttaaaaatccaagactgaaaggaaaggattgtgaaattggtcagtgaatgcgggtagcaaaaactcttcactgcctttcatttgtaactaaatctcctctgagaagagatctgtaggctttgaatgaaaggaaggaaaggcaggagccaaaggaacaggttttcgtccatacaattagtctgaatctaggttcctctgaatagaatgggcaccgcctgatccttttgtgcttcataaatgtgggtttccaacgtgcatgagatggccctcaaaccttgttacaacgatgcactttactcgtttgatgtggggggaaaaagaatgggcactacctaaaactgtttacagctagaatctgggttttatttttcatagatggagaatgcctagtggtttctaaaggcctccactgggtggagaaaggagacttgcccacctgtctggagtgttaaaaggagaaatcattgttaactgattctgttaatggattcctgccttgtaacctcccgaagggcagggacccctctcagggccttgtaaactggtgtcagcaccgctgcaaaggctgctgcacatcaggctgatggcagctaggccctaggaaggagccaggggccatggtgggggctctgctttcccacagggctggcacagaggaggcctagacatatgttgctgaaagagtgtcctaatactagagtggcatgcctcgtgtctacaaaacccttatatgtcacctctgctgtccttgaccgatggcaggggaactcccattagaatgatgatgaatcccctgcagaggggaggctggcagggacaaattccctaaaagagggaccaagcgtcagctccaattgcatcttaaaagcaaaggtgaagtaatgcacagatggaaatttaaaaagaaaacaagcagtatgactcaagtggtgtttttcacagtcagaacttgaatatcagtagatttcgtcatttgtctattccttttgtaccagaggcatattgttaaattggttaatggaaaggaaaaatgttgaacagataatgttattctttatgagacgtaccatctgtgtattgagctctgaatgtccctggatatggaagagaggaaatgtgatggaatttcaagtttgccttctttgctgtctttatcttgggttgagtatgacaaacataatcacatttatctcctggagcataaagagttttaatcaccctattaaccaggatgacatttttcacagacttaaaaaggaatagaacagacattatctccctataagcaatccatttcatggaggctgagcactagaaatgctttaaaggatggataacgcaggccatttccatttcctgtctaagccaacattaaggaggctttcggtaaggctgttgcttccactgggtgagtgttaagctttacacttagagtctcagcgcccaaaagagctattagagaaagcacgggcagggaggagtggcttccgataccccaggattcattcaagggaaaacatgtatcctggtaagttgctgctgccctgtgaaaaggagtccataggctgctgttatattcagagtcaagaaagtgtgggttcaggacaacctgagagtggaaagtgggggacgggagctgcctccgaagacgcccggcagcccatcaccaggaggaccatggcccaagggcatggaagcatgtggctgctgagagggtcgtgggccatctccaccaccaccctcgcgtcagggcatgggcccaggctggcgttaagggcactttgcctgcttagtcaaaaggtggcatcgaatcacctgggctgtcacatgttttgtttagtttcatggatagtatgggaccaaacttgcaaattaatcattgcaatctaaggggaaaatagaagaaattaaggtgggggtggggggacggggagcccatggggataaaagtaattaaaatccattgaatttagctatttcacttggggcaacatttaatctccaagattaaatcttggtttatggggaaggttatatattttcatctcatttttatgtatcatctttaagacaaattgttaagtacaaatgaaaatcaggtaacatacaaaggcatttcatcaaatagttaaatttcctatgaaagttagtaaaatacatatttttataataccatgttcaagtgaagtgtttttgctttctgccaagagtcattaaatgatatagcaagtatttgggtctctcttggtgttatcaggattaattgcccaaggctgcgattttgtgagcatagaagaggaaagcaagcatctctcacaagcagtgacatgaatctgtaataatgagtgaggctgttagcaaattttgtgtgatggcagataactcagttttggagaaaattagaatcacagctaccaagaagcacatatcgtttcaactttcccacccaagtattagtgaagtgatttaggaccttgatttatatttcttagagaagctggctcgaggcctttgtttcattactgtttgatgaggcatgatcccttactttaaaaaaaaaaaaaaaaggtgaatgtattaaatgtacttaaagacataaaaaaaaaaaaaaaaaaaaa

SEQ ID NO: 310 - DNA, 60 bp, Homo sapiens
cttcctacttgcctaggctctaattagtcagcaatcaggtttaataaaggacatttgaaa

SEQ ID NO: 311 - DNA, 3003 bp, Homo sapiens
aaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagcgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgtaaaaaaaaaaaaaaaaaaaaaaaaaaaaaaaaaaaaaaaaaaaaaa

SEQ ID NO: 312 - DNA, 60 bp, Homo sapiens
ttgtgccttctgtgaggaatggggggaacaagtggtcccaggtatccccatttccaaggc

SEQ ID NO: 313 - DNA, 2690 bp, Homo sapiens
agcagacaccagcactgctctttctccaagacggccggccatgctctcctcctctgccagtctcctccaccactctctaacctgagagcctgtggaacctgcccgtctcccctcctccatcagacacacctgcctaggaaacaggaaaggacctcggaagtcttctaaggagagtcatggcgtattaccaggagccttcagtggagacctccatcatcaagttcaaagaccaggactttaccaccttgcgggatcactgcctgagcatgggccggacgtttaaggatgagacattccctgcagcagattcttccataggccagaagctgctccaggaaaaacgcctctccaatgtgatatggaagcggccacaggatctaccagggggtcctcctcacttcatcctggatgatataagcagatttgacatccaacaaggaggcgcagctgactgctggttcctggcagcactgggatccttgactcagaacccacagtacaggcagaagatcctgatggtccaaagcttttcacaccagtatgctggcattttccgtttccggttctggcaatgtggccagtgggtggaagtggtgattgatgaccgcctacctgtccagggagataaatgcctctttgtgcgtcctcgccaccaaaaccaagagttctggccctgcctgctggagaaggcctatgccaagctgctcggatcctattccgatctgcactatggcttcctcgaggatgccctggtggacctcacaggaggcgtgatcaccaacatccatctgcactcttcccctgtggacctggtgaaggcagtgaagacagcgaccaaggcaggctccctgataacctgtgccactccaagtgggccaacagatacagcacaggcgatggagaatgggctggtgagtctccatgcctacactgtgactggggctgagcagattcaataccgaaggggctgggaagaaattatctccctgtggaacccctggggctggggcgaggccgaatggagagggcgctggagtgatgggtctcaggagtgggaggaaacctgtgatccgcggaaaagccagctacataagaaacgggaagatggcgagttttggatgtcgtgtcaagatttccaacagaaattcatcgccatgtttatatgtagcgaaattccaattaccctggaccatggaaacacactccacgaaggatggtcccaaataatgtttaggaagcaagtgattctaggaaacactgcaggaggacctcggaatgatgctcaattcaacttctctgtgcaagagccaatggaaggcaccaatgttgtcgtgtgcgtcacagttgctgtcacaccatcaaatttgaaagcagaagatgcaaaatttccactcgatttccaagtgattctggctggctcacagcggttccgggagaaatttccacccgtgtttttttcctcgttcagaaacactgtccaaagctcaaataataaattccgccgcaacttcaccatgacttaccatctgagccctgggaactatgttgtggttgcacagacacggagaaaatcagcggagttcttgctccgaatcttcctgaaaatgccagacagtgacaggcacctgagcagccatttcaacctcagaatgaagggaagcccttcagaacatggctcccaacaaagcattttcaacagatatgctcagcagaggctggacattgatgccacccagcttcagggccttctcaaccaggagcttctaacaggacctccaggggacatgttctccttagatgagtgccgcagcttggtggctctgatggaactgaaagtgaatgggcggctagaccaagaggagtttgcgcgactgtggaagcgccttgttcactaccagcatgttttccagaaggttcagacaagccctggagtcctcctgagctcggacttgtggaaggccatagagaatacagacttcctcagagggatcttcatcagccgtgagctgctgcatctggtgaccctcaggtacagcgacagcgtcggcagggtcagcttccccagcctggtctgcttcctgatgcggcttgaagccatggcaaagaccttccgcaacctctctaaggatggaaaaggactctacctgacagaaatggagtggatgagcctggtcatgtacaactgaagcaaagaggaaagcagacccatggctcaggacaagctcccagtgatcactcaagaatctggctctcattctaagaggctgtgctgcccagtatggtggttgtgataaatctaaaccagccctgcatgaaacagagtccaagctgtctcccaacagcctgggttcggtccttggctggcccaggcccagttaagcctgtggccaccaagcagctcatctgagcactttgggatgtattcagcctacgttgccctggaaaaggaagcaggagatgtctccctgtgggaaaggagaagagaagttgtctctgagtcccctgtcaccagttggattcatttcttggaagagccagaatgagccactttgaccaccctcgggtgctatgggtgacacaagagctgtccactgggtgtttgcagaataattacactatcttatgtctggatcctgatgatttcacagctaaatggcaaaaataaaacatgtttcccataaaaaaaaaaa

SEQ ID NO: 314 - DNA, 60 bp, Homo sapiens
cttatgtctggatcctgatgatttcacagctaaatggcaaaaataaaacatgtttcccat

SEQ ID NO: 315 - DNA, 7907 bp, Homo sapiens
gggaggacgcgcggcgcgcccggcggacgccgcaggtcccatgccgcgccgcgacccccgcgcccctgccgcccgcgcccgcggccgccccccgccgcccgccgccccgggctcgccgcgccgcgcccgcgcgtccttagcggggccaccgagcgatgcccgccgggcgcccgcgaaagtttgtcggctcctgctgaagggcagcggcgcccccgcacccccgtgccccgctccggccaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaaactagaaagctacggaacctgccattagtattgtggtgtatttttaagattaaaggtacactgatggacaaaaaaaaaaagtaaaacatggcaaaaaataaaataactcctatactgccctcaaaatggagtttgcaattaatatcaggatttatctttgcaaaaatcagtgatttccacattcagccagtatagccagcagaaatttctgatccacaatgcatggattcctttgaagaaaaaaaagaaaaagagaaaaaaatcacaaaaacaaactttttttattcaaaagtaacaaagttcttgtaaggtaaataatgtatttagcatgaagcatgaattattttcatataaatatagaaaatagagaaaaggctatgcctgtaatttttaagcccttaggcttagagtttcttttggttttcttcttttttctttccttttctttgctttctttttttcctttttgtttttgtttttgttttttgtttttgtttttttttcgggttattttgttttggttttttgaagcaggtgtttaaggtttaaccttcttcagggacaaattctgactgttggggaacttactctgcaatataaaaatatcttcatgctctggtagggcttggatggttgaactctgtactgccttgtgtgcacttcagccccgaccccctctgattctctgttgaaaagtgtgtcctttctctctgtctgtacatgtttaacatgacgcaataatttgagggcaaacttagtagtgagtgtgtatgatagaatcaagagaattatgggacgcttacttgagaaaatcattaccatgatttggttctaggaaaaaggcagtgaataattatgcaaattagccagaagaaggggaaccgtgctaatgggccttattgggtgaggggacgagatggggttcatgtgaaggaggaagcgatgccgaggtaggaaaggccagccccagacatcctatcgccacaatgccatgtcgcaataggaagcaggggccggccatcgctaccttcagcacactgaccaacctggaattaagaccacctagattgcgagagctgaatttagaaaccagacaacgtcatgcagcccagaaactcctgttgttacctttgcctaagaaattttctttaatggcgggggcggggggcgggggtacaaagagaaatctctaaaagaatatgatcttccatccaagtggagggaaactttaaaacaaaaacacccagtactgtggctcaggatatgatgcgtgaggagagggagggaacagagatgaccttaacttttaaaaaagggactgctgtgggccaaagccaagcccatctgccaggacgaggtaatgtcagagctccatcagcccggacagtgggaactaactggtgcattccccacacttaccttccggtgggttgctgatgagagaacctgaaaaaacctacacctctacagcaggtcgaattcatgacctgaagctgaatacttccagcatatttattcagggtgtaggtgggaataaagtatcttcgcagtgctctgttccctccgtctccccagacatctgacaccctaaaagccatccacagctatggaacctgagcgacaccttgatttgtgttgtcacctgaccaagcctaaagacctccagctcagtcccccaccttcatcccaccccacagatgataaaattcagacctctctcctgaaaggcagaggttcaacattcaggactgtttctggccgaggacttcttccaattaaaacccccaccgtgggctgtctcccctcatttcatttttctaaaggggcagaggcctcttttagaaaataataaaatgcaatgtgtgtgatttacttttctgatctctttgagaaatagagaaatataaaagtgtgttcttaactccagaaccactctttttgcataaatacctcatcgggcagctttctaagtgtgattttcctgagtctcccttcgttggatctgccggaagacttgtcggggaacctttagtgagggtacttcttcctatttttcttctgtttttggaggcatacacattatgcataaccaaaacaatggctcaattgtgtttaactttgtattttgattgttgagaacaaaaacaaaaagtatcaatgtgtatgtggctgtttgtagtgaatttattggagaatgaggttgtccgtgtccttaacaagccaaggggcaggaggcaccctctcttatcccctcctccaagagcagtagagaatttaagcacaagcctatttgtgaaagaatattttgcttaagtgtcattcactttagtcttggaattccttcccaaacgtcaggtgttcttttagcttccaaactagcatatgtatccattagtctgacagatcgcctgaacaccattaagaggtgtggcgtttttgctttcatttctcctgctgggagaagtggcggttcatgtgtcattccagtatctcacatactcacacggggcaggggggagggggaaacggggaactatagcaatatttaaagatgctttggaaaccaaccgtgaacacatcaacaccacgacgtctacgattacttgctattggccctcggatacatttaagagaaagagacagtcactcttttttttcttaaatgatatacatataaacagttatttttatcctattataattgtcttttgtctttatctagtactatgtggaaagggtttgcatcatagatttttcccagccttataatataccataagctcctacttccctgcccctccctaatcagtattctttcaagagttctttggtgaagccatctatctgaaactaaaatgaaccaaacccatatttcactggtggttggagaaaaccatggccaaaacgattgtggcaggtctcaatcttgggagtttttaagaaggaatgtgccagaggccgattcccaagaacagagttttcttttgttttgcagaggcattcaatgtgtctagtgcttgctggccacagcagttactaccacagagccttctgggaggggccgttgtgttgaaggaggctcctgcctgagggacagcatcaggcagtgggctctgtagagtgagaaccaggtggaggccttctgtgcccagctcagagttctgcaccacgccaggactgcccaggccaagggctactgacgcaagttccactcattccactctgtggggggcgccttgggcctctcctggaagggctcttggagaaggaattggagttacgtacaagtgacctaaatgggaagcttttctagatgagattggattaaattccatgtgatttctctttccctttaatccaggttgggactcgtttctttctggtggatcacagctgcccagatgttgcaattgatttttatgtttctgtagagaagtatttttctttcatcttcaggattttttttgccaccaaaagaaaacattggaactctgtgtttcctcttgattgtgacttcccagtgttgacagttaagtccttagtgtcgtaggtcccagcccaccaatactatatcaaacactgttatgcacataatgcagcactgtgatctaatttaaataatacttttttattatttatactactatatataatatacatcaacacttttgctatataacctaagtgataaccctcttttagttacctgccaaactctggacttggtttatattgcagttaacacagttacaaagctgtaatggtgtctttttttcctttgtaacggaatgtgtaaatcaaagtatatacattgtgtggtgttcctgtttctggagtttcatgaggatttacacatggcattcagtgttctgtatagatctgcctacctttgtgaattcatctgttaacccctcttcctttgagagagcaccggcgatggtggttaactccttgtgttttctctctctcctactggttattcttgaattaagcacagactcgtcagctcggttgctttatcatgaataatgtgtgtgaccttgcagttcttccacagttcagcaaacaagtgctagcttcactgaccaaaaattaaggaaggaaaacacagtttttaaaacgatccatcttttaacagccgaaaccgatgtgtctatggtgctgcaccttgctgttgtacttctgaaatcagacgtgtgtgaacgatcatttctgacttaaccgtgagatgctcacgagtacccttcctgttgttttgttagcattgaaatcgagactatttatttggaatatatacaacagtgtttttccactgtatttcatttgcaaaagttgagaactgctttctctaccttttgcaaaataattgatattccatattggattctcaaagacttcgatatggtgaacctattaaacctagaaattgtattcatcctttcatgactgtggcctgagttccccagcccctctcctccttttttttagatgagatttagcacactctcagttatttaaacatgcaacatttcttgagtatgtatgttgaggccatctgagctcatagctgattcagtaaccagtttcatgctgtgtcattcacactcactacttaatactgccatggtgaaaatgtggaggaaaaatgtatccatgtgtgtctgggaagcatatacacttgtacattttttaatactctgattctgtaacatttctgagttttgttttgttttacagaaaaaaaaaaaaagtgataaagcaatcagaagaccaagaggtttactattgatgcttagggtcgtctgaccttggctggccaatagacctacacggccaaattaatttacgagagtaataatttttcaaaagccaattttttttctgtattttctgtatgaaactgccaatatcatgaatagaaagggagaaccataaaggagaaagaacgtgatgttctgttatgttcatgtaaacctaaagaaacagtgtggaggcaggcgcgatcagccgaactctagggacttggtgttgcttggaaggcatccatacctgcattttgcattcttcgtatgtaatcatattgccaaagacaaactatttcatcatttattgtaaataacacttttccccagacctaccataaagtttctgtgatgtattgtcttccagttgcaataaaaattactgagttgcatcaattgaagaaaaacaccaaaaa

SEQ ID NO: 316 - DNA, 60 bp, Homo sapiens
cctaccataaagtttctgtgatgtattgtcttccagttgcaataaaaattactgagttgc

SEQ ID NO: 317 - DNA, 2231 bp, Homo sapiens
cctttgcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcctgtgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaactaaaaaaaaaaaaaaaaaaaaaaaaaaaaaaaa

SEQ ID NO: 318 - DNA, 60 bp, Homo sapiens
tgaaacttttaagtatactttaggaaacaagcatgaacggcagtctagaataccagaaac

SEQ ID NO: 319 - DNA, 1255 bp, Homo sapiens
cgctcgctcccgcaactggaggcacggcagaggaggcagggccgacggcggtgggcggtgcgttgcgcaggctcgggcctcccgctcgccgctgcgttgggaccgcgcagcccggtgtgtgcagtggcctcagggatccggaaagtctaggactgaacttctcctaacatccagtaatggggacctggaacctgggcgtactagagtgccgcgcgtagggctccaggtcgctggcttctgcgctttcttcctctccaaagttgagtatctcctatctgtgtcctcatacatactgccgcctgaggtgccatggcccccaagccgggggccgagtggagcacagccctgtcccatctggtgctgggagtggtgtctctgcacgcagccgtgagcacagccgaggcaagtcgaggggctgctgctggcttcctgctccaggtcttggctgccaccaccacgctggccccagggctgagcacacatgaagactgccttgctggagcctgggtggccaccgtcatcggccttccccttctggccttcgatttccactgggtgaatggggaccgctcctctgccaacctgctcctgggaggaggcatggtgctggcagtggctggcggccacctcggccctgagggccgctctgtggctggtcaggcaatgctgttggtggtcgcagtgaccatcctcattgtagctgtcttcacggccaacacttatgggatgtgggggggggcgatgctgggtgtggcaggcctcctgagccggctggaggaggacaggctgctgctgctaccgaaggaggatgtctgtcgctgggccttggctgtaggcagctgggcttactgccgggccctgcatacacagcgcctccagtgggagtgacagttggatacagccaggcagggtttctgccctgccgaacactttccctcccacctgcctgctcctggcgccttctccctaggggtagactcttctgcctactgaagtgggtttgctgcacattgactggtcaggggcagagtctgggtgctgtcctttggccacgtgtggggacttgtctagaccagaatgaaagggacagggtcccagacacgtttgggggtcctgattctgggctggacacggttgtggatccagagaagaggcctagtctccaataaatcttaggaattttgcaggaaaaaaaaaaaaaaaaaaaaaaaaaaaaaaaaaaaaaaaaaaaaaaaaaaaaaaaaaaaaaaaaaaa

SEQ ID NO: 320 - DNA, 60 bp, Homo sapiens
cctaggggtagactcttctgcctactgaagtgggtttgctgcacattgactggtcagggg

SEQ ID NO: 321 - DNA, 2187 bp, Homo sapiens
cagagcagcggagctgccccgaacaaagatggcgcgggaagcgtctgtgagggcagactgatccgagcacccaaaccctcggcggacagcggagccagtggtagccgcacggccctaaaaccatggaggagggcggcagcactggcagtgctggcagtgacagcagcaccagcgggagtggcggggcgcagcaaagggagctggagcgcatggctgaggtcttggtcaccggggaacagctacggctcaggctgcacgaagaaaaggttattaaagatagacgtcatcatctcaagacctacccaaactgttttgtcgcaaaagaactgattgactggctgattgaacacaaagaggcttctgacagagagacggcaattaaactcatgcagaaattagcagaccggggcattattcaccatgtgtgtgatgagcataaggaattcaaggatgtcaaactcttctaccgctttagaaaggatgacggcaccttcccattggataatgaagtgaaggcctttatgagaggacagaggctatatgaaaagctgatgagccctgaaaacacactcctgcagcccagggaggaggaaggggtcaagtatgagcgcaccttcatggcatctgaattcctggactggctggttcaggaaggtgaggccaccacgaggaaagaggcagagcagctttgccaccggcttatggagcatggcatcatccagcatgtgtccagcaagcacccatttgtggacagcaatcttctctaccagttcagaatgaacttccggcggaggcgaagactgatggagctgctcaatgaaaagtccccctcctcccaggaaactcatgacagtcccttctgcctggggaagcagagccatgacaatcggaaatctaccagctttatgtcagtgagccccagcaaggagatcaagatcgtgtctgcagtgaggagaagcagcatgagcagctgtggcagcagcggctacttcagcagcagccccaccctcagcagcagcccccctgtgctctgcaaccccaagtccgtgctgaagagacctgtcacctctgaggaactccttactcccggggctccgtatgcaaggaagacattcacgattgttggtgacgcggttggctggggttttgtggtgcgaggaagtaagccatgccacatccaggctgtagaccccagtggccctgcagccgcagcaggaatgaaggtctgtcagtttgtcgtctctgtcaacgggctcaatgtcctgcatgtagactaccggaccgtgagcaatctgattctgacgggcccacggacgattgtcatggaagtcatggaggagttagagtgctgagctcctgggcctcccagccctccagtggcctgtgggtgagggaagccagaatgacacaaagcaatgcaaagacaagattgccatgcaaatggatggttttggacatacgagtcttctccgcacatacatgtctaaagttgagttttatacactgaatgtggaagaaccgggtatcatatcttttttaaaaaatgtcagtgtagaaaacatttgggaaaccattttcctacatgatagaactgccttactagatttctatttgtagctctcattcattgttttttatcttagtttgcagaaaggtgttgaaatgcttctctagcccaaacagcgacatgctaaagtccccttcttcagagtcaatagagtagttgttaaaggttttaaattgtactttctccaaaattagcatgcagctatttaatagggaatctagatttcaccaagattcaaatcaaagcaacatttaaaggaataagacctgttcactagcattttcaagggggttctaaagcattcaagtgcttaaaagccataaaaaatgacttcttaattcctgcctttagtgtcaacttttaagttaatacaggtttcaattgtggcattaggaaaaaaaaaaaaaccttgtgatgctatggttgggggtagttagggagagactacatgaaattgtgtgcccctattttctttctgatcctaaatcattttgttttataaatcagctatagcatctttctagaattaatcctgaatatgttgaatgttaaaatagagaagtttgtatatacacataattaaaaatcaacccttctggcaaaaaaaaaaaaaaaaaaaa

SEQ ID NO: 322 - DNA, 60 bp, Homo sapiens
gacttcttaattcctgcctttagtgtcaacttttaagttaatacaggtttcaattgtggc

SEQ ID NO: 323 - DNA, 1892 bp, Homo sapiens
gtccctcccagatctctgagctagcaagcactgcagcccgagccaattgcgaaagaccaacaaagcccagcccagcggaaggaacggtttcggagttgtttttctttgatacgggagttcctccttgctctcgcccctactctttctggtgttagatcgagctaccctctaaaagcagtttagagtggtaaaaaaaaaaaaaaacacaccaaacgctcgcagccacaaaagggatgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataagcatggactggaggaaacagctgccaaatgcaagggactgggtgccaaggttcatacctttgtggtagactgcagcaaccgagaagatatttacagctctgcaaagaaggtgaaggcagaaattggagatgttagtattttagtaaataatgctggtgtagtctatacatcagatttgtttgctacacaagatcctcagattgaaaagacttttgaagttaatgtacttgcacatttctggactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacaaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactatatctagtggtatttcacaatgaatatcatgaactctcaatgggtaggtttcatcctacccattgccactctgtttcctgagagatacctcacattccaatgccaaacatttctgcacagggaagctagaggtggatacacgtgttgcaagtataaaagcatcactgggatttaaggagaattgagagaatgtacccacaaatggcagcaataataaatggatcacacttaaacttttggtgtttccatctttttgtcttaaacagaacatgacaaccttcaaattaaaggaaaataaattgtgaaaaaaaaaaaaaaaaaaa

SEQ ID NO: 324 - DNA, 60 bp, Homo sapiens
aggagaattgagagaatgtacccacaaatggcagcaataataaatggatcacacttaacg

SEQ ID NO: 325 - DNA, 1504 bp, Homo sapiens
tggttgctaagacactcttgtttcgctccttgacaaccctggcgggggttcgctggctgcggccccggctccggcccccgcaggagcagcaccccccggggaaagacattttctgctcccaccgagttggcagggcctgcttcctgaatctcctgggtgtgtcttaactgccagtcccagcacctcctgaaagccccactctcctccagtggtcacagtggaaggatcatgggagaaacagaagggaagaaagatgaggctgattataagcgactgcagaccttccctctggtcaggcactcggacatgccagaggagatgcgcgtggagaccatggagctatgtgtcacagcctgtgagaaattctccaacaacaacgagagcgccgccaagatgatcaaagagacaatggacaagaagttcggctcctcctggcacgtggtgatcggcgagggctttgggtttgagatcacccacgaggtgaagaacctcctctacctgtacttcgggggcaccctggctgtgtgcgtctggaagtgctcctgacactctgtcccctgccccgtcccctgcagggccttttcctgccactcatctggggtggggagcagccctaggcaggtcctggtttttccaaggagagttggggtcttttctttttgtctttgtgtaccagtttcctgagccacgcccagtgtgtgaacttgacatctccatccccaggctctcaaccgtctccctcggagtctcagggtgtggacggggcagcgggcatgggtctgtgtgggagacgtggggtggggcggtgtgacagggtagaggaggtgggagatgagatcttccgcacaggaacacgccagtccccctttctccagggctgccttccccttgcatcctgggagccccactgccctgccatccccagtactgccgggaagtgtcggccgtccttgtcattagtggtcatatgaaaatggccccaagaaggagatgattctttcaagggacacaggcagcttctctccttgtcctctggggaggtgctgacccctcagaaaccccttcccccaacttgaccccaggctgaacagaccactgcatctcactgggccagcagcccccccagcccccagccttggtggggaccaagcagcctttcccgtcccctcctcgacccgtacagttgagagccaggggctggtgtgtgggagctgctacctggcagtttctcgaggggtcaccgagcctctggtgggacacctgggcaggagtgctctcaccacgaggctgcttccgcagggaaccctggcctgcccgcgacttcgcatcagggaccgcatgctgatttgtactgctctctgctgggttttctatgttcttttcgagtgtgggaaaagggttttagtagaagggtgaatcgtattttacacagcggtcttatttatataaatgtcttggtttttacaattaaaatgaccaaaaactgaaaaaaaaaaaaaaaaaa

SEQ ID NO: 326 - DNA, 60 bp, Homo sapiens
gtgggaaaagggttttagtagaagggtgaatcgtattttacacagcggtcttatttatat

SEQ ID NO: 327 - DNA, 1905 bp, Homo sapiens
gctgtcttttcagtcgggcgctgagtggtttttcggatcatgtctggtggctccgcggattataacagagaacatggcggcccagagggaatggaccccgatggtgtcatcgagagcaactggaatgagattgttgataactttgatgatatgaatttaaaggagtctctccttcgtggcatctatgcttacggttttgagaagccttccgctattcagcagagagctattattccctgtattaaagggtatgatgtgattgctcaagctcagtcaggtactggcaagacagccacatttgctatttccatcctgcaacagttggagattgagttcaaggagacccaagcactagtattggcccccaccagagaactggctcaacagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacctttctccaaaatggatcaaaatgtttgttttggatgaagcagatgaaatgttgagccgtggttttaaggatcaaatctatgagattttccaaaaactaaacacaagtattcaggttgtgttgctttctgccacaatgccaactgatgtgttggaagtgaccaaaaaattcatgagagatccaattcgaattctggtgaaaaaggaagaattgacccttgaaggaatcaaacagttttatattaatgttgagagagaggaatggaagttggatacactttgtgacttgtacgagacactgaccattacacaggctgttatttttctcaatacgaggcgcaaggtggactggctgactgagaagatgcatgccagagacttcacagtttctgctctgcatggtgacatggaccagaaggagagagatgttatcatgagggaattccggtcagggtcaagtcgtgttctgatcactactgacttgttggctcgcgggattgatgtgcaacaagtgtctttggttataaattatgatctacctaccaatcgtgaaaactatattcacagaattggcagagggggtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtataaaagatggggtctgtaaaatctttctttcttagaaatttatttcctagttctgtagaaatggttgtattagatgttctctatcatttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattcaataaagtatttaattagtgctaagtgtgaactggaccctgttgctaagccccagcaagcaatcctaggtagggtttaatccccagtaaaattgccatattgcacatgtcttaatgaagtttgaatgttaaataaattgtatattcactttaaaaaaaaaaaaaaaaa

SEQ ID NO: 328 - DNA, 60 bp, Homo sapiens
ggttataaattatgatctacctaccaatcgtgaaaactatattcacagaattggcagagg

SEQ ID NO: 329 - DNA, 2196 bp, Homo sapiens
ctgggcgggtcatgcgccctggccttcgcgcatctcccaggttagctgcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagcttctcaataccccggcccctctgccgacctcttgcaatccaagtgacatgagccatgggtacgtgacagtaaagcccagggtccgtctgcattttgtggagctgggctccggccctgctgtgtgcctctgccatggatttcccgagagttggtattcttggaggtaccagatccctgctctggcccaggcaggttaccgggtcctagctatggacatgaaaggctatggagagtcatctgctcctcccgaaatagaagaatattgcatggaagtgttatgtaaggagatggtaaccttcctggataaactgggcctctctcaagcagtgttcattggccatgactggggtggcatgctggtgtggtacatggctctcttctaccccgagagagtgagggcggtggccagtttgaatactcccttcataccagcaaatcccaacatgtcccctttggagagtatcaaagccaacccagtatttgattaccagctctacttccaagaaccaggagtggctgaggctgaactggaacagaacctgagtcggactttcaaaagcctcttcagagcaagcgatgagagtgttttatccatgcataaagtctgtgaagcgggaggactttttgtaaatagcccagaagagcccagcctcagcaggatggtcactgaggaggaaatccagttctatgtgcagcagttcaagaagtctggtttcagaggtcctctaaactggtaccgaaacatggaaaggaactggaagtgggcttgcaaaagcttgggacggaagatcctgattccggccctgatggtcacggcggagaaggacttcgtgctcgttcctcagatgtcccagcacatggaggactggattccccacctgaaaaggggacacattgaggactgtgggcactggacacagatggacaagccaaccgaggtgaatcagatcctcattaagtggctggattctgatgcccggaacccaccggtggtctcaaagatgtagaacgcagcgtgtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatgactatgctgctggctgtctttgttcttggagaggtggagtgactgttcacggagaa

SEQ ID NO: 330 - DNA, 60 bp, Homo sapiens
cagccgttcatttagaagaatcttagcagagattgggatgccttactcaataaagctaag

SEQ ID NO: 331 - DNA, 5511 bp, Homo sapiens
acacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatcca

SEQ ID NO: 332 - DNA, 60 bp, Homo sapiens
gaaagaggttaggagtagatattgattactatcataattcagcacttaactatgagccag

SEQ ID NO: 333 - DNA, 2857 bp, Homo sapiens
gcattactcatactcagcggacaaaggatcactcagcattcaatctcaccacttcaaaacattacagagggaaaacgacacctagaagtaggagtgagattcgctgaagttcccttctgaggaagacccacccctccgcctggagagccggggctggcggtgcctgaggaccccttcggcctggacagcccacgcgggcttggggggcctcgctctgccctcatggggcggccatcggttcccgaagcggcgagtgaaaattcaaatggccagtagggggcgcactcggaagtggccgccccgcatgaggcagttcagcggccccgagagtccggggagggaggtttattctccgcctgcacgagactgtgaaatccgcaaccatgagcaggagaggcggccctggtggggaagaggccaccaacatctggacggcaggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggtgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaaaccccctcatctacagctttctcggggagaccttcagggacaagctgaggctgtacattgagcagaaaacaaatttgccggccctgaaccgcttctgtcacgctgccctgaaggccgtcattccagacagcaccgagcagtcggatgtgaggttcagcagtgccgtgtagacagccttggccgcataggcccagccagggtgtgactcgggagctgcacacacctgggtggacacaaggcacggccacgtcatgtctctaaactgcggtcagatgtggcttctggctcctcggggcctcgcgagggtcacgcttgcctggtcaccctggggctgcttaggaaacctcacgactggtcaccttgcactcctcacacagaattgctacaatcccaaagcgctcgccccgcagggtccaaaggccagcggtgaccagcctgtcacccagctcctccccgccaaccctgcctgccgctgcacctgcctgccgctgcaggaaacatttctgacaccgtcgaccaggaaagccacacggagaggccactgtgggtgaagcgcctcagttacacaggaaccctaaagcaaatctgccaccgtgggggaactgacgctggagatgcaaggtgctggtgggtctgagctggacgtcgcggtgtgtcctctgtgcccacggtctgagctagctagcgcaccgccgagttaaagaggagaaggaaaacatgctgctctggtgcacgcctgagcgtcctccatcttccaggatggcagcaatggcgctgtgcggcctcaccaggcccacgaggagcagcagcgctcggcccggagcagcaggaaggcccctctgtggagcgcccgccgtctgctccggggtggttcagtcactgcttgttgacatcaacatggcaattgcactcatgtggactgggaccgtgcgagctgccgtgtgggttagtcgggtgccaggacaatgaaatactccagcacctgtggctgacgaatttgtttctacagaaataacagctggggacaactgcggtgatgatgtaaaaaccttcccataaaatgtaagaaaagctgatgaggctggtgacgttcagcctttgtcaataaacctgtcatgtgcggatccttaaaaaaaaaa

SEQ ID NO: 334 - DNA, 60 bp, Homo sapiens
gacaactgcggtgatgatgtaaaaaccttcccataaaatgtaagaaaagctgatgaggct

SEQ ID NO: 335 - DNA, 546 bp, Homo sapiens
aaagcggccatgttttacatatttcttgattttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagccccccta

SEQ ID NO: 336 - DNA, 60 bp, Homo sapiens
ttgaaccttaatttcttcacctctaaaatggaggtaatacttaccttaagtggctatgag

SEQ ID NO: 337 - DNA, 523 bp, Homo sapiens
gattattttctcaggtgtttgcaacagtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaactttgccaagtaagcatctttacacctaatcccaaaggctcttttaagagccacgcatgttttcaataaatgagttgtaatcatttcattcaa

SEQ ID NO: 338 - DNA, 60 bp, Homo sapiens
atctcttccaaggcaatggggatcatgaattccttcgtcaacgacatcttcgagcgcatc

SEQ ID NO: 339 - DNA, 496 bp, Homo sapiens
ctcgcttttcggttgccgttgtcttttttccttgactcggaaatgtccggtcgtggtaagcagggtggcaaggcgcgcgccaaggctaagtcgcgctcgtcgcgcgcggggctgcagttccccgtgggccgcgtgcaccggttgctccgcaagggcaactattcggagcgcgtgggcgccggcgccccggtctatctggccgcggtgctcgagtacttgactgccgagatcctggagcttgccggcaacgcggcgcgcgacaacaagaagacgcgcatcatcccgcgccacctgcagctggccatccgcaacgacgaggagctcaacaagctgctgggccgcgtgaccatcgcgcagggtggcgtcctgcccaacatccaggccgtactgctgcccaagaagacggagagccaccacaaggccaagggcaagtgaggccgcccgccgcccccggggcccctttgatggacataaaggctcttttcagagccaccta

SEQ ID NO: 340 - DNA, 60 bp, Homo sapiens
gttttaataacgctcaccgtaaaggtgtcttcataattactagtgacaagttctcttgac

SEQ ID NO: 341 - DNA, 3047 bp, Homo sapiens
tcttgcgtcaagacggccgtgctgagcgaatgcaggcgacttgcgagctgggagcgatttaaaacgctttggattcccccggcctgggtggggagagcgagctgggtgccccctagattccccgcccccgcacctcatgagccgaccctcggctccatggagcccggcaattatgccaccttggatggagccaaggatatcgaaggcttgctgggagcgggaggggggcggaatctggtcgcccactcccctctgaccagccacccagcggcgcctacgctgatgcctgctgtcaactatgcccccttggatctgccaggctcggcggagccgccaaagcaatgccacccatgccctggggtgccccaggggacgtccccagctcccgtgccttatggttactttggaggcgggtactactcctgccgagtgtcccggagctcgctgaaaccctgtgcccaggcagccaccctggccgcgtaccccgcggagactcccacggccggggaagagtaccccagccgccccactgagtttgccttctatccgggatatccgggaacctaccagcctatggccagttacctggacgtgtctgtggtgcagactctgggtgctcctggagaaccgcgacatgactccctgttgcctgtggacagttaccagtcttgggctctcgctggtggctggaacagccagatgtgttgccagggagaacagaacccaccaggtcccttttggaaggcagcatttgcagactccagcgggcagcaccctcctgacgcctgcgcctttcgtcgcggccgcaagaaacgcattccgtacagcaaggggcagttgcgggagctggagcgggagtatgcggctaacaagttcatcaccaaggacaagaggcgcaagatctcggcagccaccagcctctcggagcgccagattaccatctggtttcagaaccgccgggtcaaagagaagaaggttctcgccaaggtgaagaacagcgctaccccttaagagatctccttgcctgggtgggaggagcgaaagtgggggtgtcctggggagaccaggaacctgccaagcccaggctggggccaaggactctgctgagaggcccctagagacaacacccttcccaggccactggctgctggactgttcctcaggagcggcctgggtacccagtatgtgcagggagacggaaccccatgtgacagcccactccaccagggttcccaaagaacctggcccagtcataatcattcatcctgacagtggcaataatcacgataaccagtactagctgccatgatcgttagcctcatattttctatctagagctctgtagagcactttagaaaccgctttcatgaattgagctaattatgaataaatttggaaggcgatccctttgcagggaagctttctctcagacccccttccattacacctctcaccctggtaacagcaggaagactgaggagaggggaacgggcagattcgttgtgtggctgtgatgtccgtttagcatttttctcagctgacagctgggtaggtggacaattgtagaggctgtctcttcctccctccttgtccaccccatagggtgtacccactggtcttggaagcacccatccttaatacgatgatttttctgtcgtgtgaaaatgaagccagcaggctgcccctagtcagtccttccttccagagaaaaagagatttgagaaagtgcctgggtaattcaccattaatttcctcccccaaactctctgagtcttcccttaatatttctggtggttctgaccaaagcaggtcatggtttgttgagcatttgggatcccagtgaagtagatgtttgtagccttgcatacttagcccttcccaggcacaaacggagtggcagagtggtgccaaccctgttttcccagtccacgtagacagattcacagtgcggaattctggaagctggagacagacgggctctttgcagagccgggactctgagagggacatgagggcctctgcctctgtgttcattctctgatgtcctgtacctgggctcagtgcccggtgggactcatctcctggccgcgcagcaaagccagcgggttcgtgctggtccttcctgcaccttaggctgggggtggggggcctgccggcgcattctccacgattgagcgcacaggcctgaagtctggacaacccgcagaaccgaagctccgagcagcgggtcggtggcgagtagtggggtcggtggcgagcagttggtggtgggccgcggccgccactacctcgaggacatttccctcccggagccagctctcctagaaaccccgcggcggccgccgcagccaagtgtttatggcccgcggtcgggtgggatcctagccctgtctcctctcctgggaaggagtgagggtgggacgtgacttagacacctacaaatctatttaccaaagaggagcccgggactgagggaaaaggccaaagagtgtgagtgcatgcggactgggggttcaggggaagaggacgaggaggaggaagatgaggtcgatttcctgatttaaaaaatcgtccaagccccgtggtccagcttaaggtcctcggttacatgcgccgctcagagcaggtcactttctgccttccacgtcctccttcaaggaagccccatgtgggtagctttcaatatcgcaggttcttactcctctgcctctataagctcaaacccaccaacgatcgggcaagtaaaccccctccctcgccgacttcggaactggcgagagttcagcgcagatgggcctgtggggagggggcaagatagatgagggggagcggcatggtgcggggtgaccccttggagagaggaaaaaggccacaagaggggctgccaccgccactaacggagatggccctggtagagacctttgggggtctggaacctctggactccccatgctctaactcccacactctgctatcagaaacttaaacttgaggattttctctgtttttcactcgcaataaattcagagcaaacaaaaaaaaaaaaa

SEQ ID NO: 342 - DNA, 60 bp, Homo sapiens
aagaacctggcccagtcataatcattcatcctcacagtggcaataatcacgataaccagt

SEQ ID NO: 343 - DNA, 1458 bp, Homo sapiens
acttccggggcggatcggaagttgctttgttttgcttcgagatggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagagccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttggcctgctgtgtttattgtagagacactgttttagtaaacatgctgagcattcaaaaaaaaaaaaaa

SEQ ID NO: 344 - DNA, 60 bp, Homo sapiens; identical to SEQ ID NO: 177

SEQ ID NO: 345 - DNA, 3354 bp, Homo sapiens; identical to SEQ ID NO: 106

SEQ ID NO: 346 - DNA, 60 bp, Homo sapiens; identical to SEQ ID NO: 107

SEQ ID NO: 347 - DNA, 2258 bp, Homo sapiens
agggaagctcctataaagggctgcatctctggactcacagctatcagaccattgagatgtggaagctgttgctgtgggttgggctggttcttgtgctgaaacaccacgatggtgctgcccataaactcgtgtgttatttcaccaactgggcacacagtcggccaggccctgcctcgatcttgccccatgacctggacccctttctctgcacccacctgatatttgcctttgcctcaatgaacaacaatcagattgttgctaaggatctccaggatgagaaaattctctacccagagttcaacaaactaaaggagaggaacagagagctgaaaacactactgtccatcggcgggtggaactttggcacctcaagattcaccactatgttgtccacatttgccaaccgtgaaaagtttattgcttcagttatatcccttctgaggacacatgactttgatggtcttgaccttttcttcttatatcctggactaagaggcagccccatgcatgaccggtggacttttctcttcttaattgaagagctcctgtttgccttccggaaggaggcactgctcaccatgcgcccgaggctgctgctgtctgctgctgtttctggggtcccacacatcgtccaaacatcctatgatgtgcgctttctaggaagactcctggatttcatcaatgtcttgtcttatgacttacatggaagttgggaaaggttcacaggacataatagccccctcttctctctgcctgaagaccccaaatcttcggcatatgctatgaattattggagaaagcttggggcaccctcagagaagctcatcatggggatccccacctatggacgtacctttcgcctcctcaaagcctctaagaatgggttgcaggccagagcgatcggaccagcatctccagggaagtacaccaagcaagaaggcttcttggcttattttgagatttgttcctttgtctggggagcgaagaagcactggattgattaccagtatgtcccgtatgccaacaaggggaaagagtgggttggctatgacaatgccatcagcttcagttacaaggcatggtttataaggcgagagcattttgggggggccatggtgtggacattggacatggatgacgtcaggggcacgttctgtggcactggccctttcccccttgtctacgtattgaatgatatcctggtgcgggctgagttcagttcaacttctttaccacaattttggctgtcatctgctgtgaattcttcaagcactgaccctgaaaggctggctgtgaccacggcatggaccactgatagtaagattttgcccccaggaggagaggctggggtcactgagatccacggaaagtgtgaaaatatgactataacccctagaggtacaactgtgacccctacaaaggaaactgtatcccttggaaagcacactgtagctctaggagagaagactgagatcactggggcaatgaccatgacttctgtgggtcatcagtccatgacccctggagagaaggccctgacccctgtgggtcatcaatctgtgaccactggacagaagaccctgacctctgtgggttatcagtctgtgacccctggggaaaagaccctgacccctgtgggtcatcagtctgtgacccctgtgagtcatcagtctgtgagccctggaggaacgactatgacccctgtccattttcagactgagacccttagacagaatacagtggcccctagaaggaaggctgtggcccgtgaaaaggtgactgtcccctccagaaacatatcagtcacccctgaagggcagactatgcctttaagaggggagaatttgacttctgaggtgggcactcaccccaggatgggtaacttgggtcttcagatggaagctgaaaacaggatgatgctgtcctccagccccgtcatccagctcccggaacaaactcctctagcttttgacaaccgctttgttcccatctatggaaaccattcctctgtcaactcagtaacccctcaaacaagtcctctttctctaaaaaaagaaatcccagaaaactctgctgtggatgaagaagcctaagcccctctggtgtcagaaaccagggaaaacccttgtcttttcttctaagtgacatgttggaagccttctcatcccggggcaaagcaggcatcaaaaccagaataggccaatctcttttccattaaataaactgtaaacacaagaacccaaaaaaaaaaaaaaaaa

SEQ ID NO: 348 - DNA, 60 bp, Homo sapiens
ggcatcaaaaccagaataggccaatctcttttccattaaataaactgtaaacacaagaac

SEQ ID NO: 349 - DNA, 3967 bp, Homo sapiens
ccacgcgtccgatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggtccttttggaataaatcatgggattgagcttcattcagatgtggtggaatatgccaaggaaaaactggagagcttcatcaaaaatagtgatagctttgataaatttgagttctgtgaacctgcatttgttgttggtaattgcctccagatagcttctgacagtcatcagtatgatcgaatttattgtggagctggagtacagaaagaccatgaaaactacatgaaaatattactaaaagttggaggcatattagtcatgcctatagaggatcagttaacacagattatgcgaactggacagaacacttgggaaagtaaaaatatccttgctgtttcatttgctccacttgtgcaaccaagtaagaatgataatggcaaaccagattctgtgggactccctccctgtgctgtcaggaatctacaggacttggctcgtatttacattcgacgcacacttagaaatttcataaatgatgagatgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggatatcaaagaagaggaggaaaaagatcacaatgaagcaatgaagccagaggagccacctcaaaatttactgagagaaaaaatcatgaagctgcccctccctgaatctttaaaagcttacttgacatattttagagacaaataacttagatcaagaagaaaaatgcctactgataattcctttagtcttgaaaatgtagcatttgttaggagttaaaagagagaattatttctttcatcagagcaaattatagtggaaaaaaaaatcacttgtttctgtcagtaacacaaatgatgtattcagtgaataaaagaatcccttttataaaatctatttttctttaaatcttggaaaaatgttgttttagctcagagtgatttcaaagtggaatgcaacagtagtcaagacttgtgtactataaatccttttctgattccttacagatttgtagtgatgaggtttagatttaattttatatatggtttaaataattgttaagcttatataacctgatctgaattgcagttgtttgcatttcctctatgaaaacttcatttatctaataaggaagtcaaatgctttgtagactatttaccttacttttgttgcaatcactgttgttgggttgctgtatatatattccgggcaatatatgagtgcaataacaatacaagatattgaataatttagctttaaaaaatcccacaaattttatgaaattttacagccctgctacttttgcttttgaatctcttgccaaaagacatgggtaaaatatctgcctctctcatagagattttaagagcacagcaagtgaattattaaaacaaagtctatacttaatacaactctttatatggaccctttacattttcagtatttaaaaaaataactctatagaattttaaaagtatatttagaattgttttttctgtagttcactgtataaagtatttggttttttaaaaaaagcaaaaccattgttatgtgtgactcttgataggacacagaacgagtgaatgagcatgagtgaggccactttcttggatggctgtaagtagcagggccagggtagacctggtcagcggatgcactttagcagatggaacttctagtttatctgaatatttatctttgacaaggtagggctgagcctacatttgcttttgatctatctagtataagaaatattcacagaaattgtatgtagataccctttgttttgaaaatgctgttcagaatcatagtgtaatctttgggacctatgccatgttcatttcactccttcccatattttttgtgtttcttttggtaaaactataatggttttcattttttacttaatatcacacagttaaactgtccatatttgagctttattttagcttatcagtgataaaaaacaggtagtaactgccattgtttgtttgttttcctaataaggcctgaaaacagccattccttgttaagaaagtgtacaatgtaacatatttgctagagttacatggattatatatttcttaaagggaaaaatttgagagtatcatggactaccaccagcattattattacagtagttactcagatttggttaaggaagcccaagcaatgtatagtgaaaggattattatctctctgctaagattcagatattgtttcagaaatctcagctccagtaattccacaacatctaaaaacaaatgtttgtgatcatgtgtaagcatgaaattgttccaagtaagtgaggatattttagttatgtgaaagacagtttcatggaaggtatttgttttgtaccagtggctgggatggtggaattggggttatttctacaattattcttagacgattactaaactgttaagaaatgccccatatcatttttgtatctaggaaagaaaaaaatcagtttcatactgttgtcatctgtcagaaatgctcattttattttgaattaaatgtggcttttgaagtacctagttaccttgaattcctggtgaccacatgtttttatctggaaaacctggagaaagttatctgtcccatctcccctgcttgttttttttttttttttttttggttggagctgctgtttagatgatgcttttactatgcaggagagagtttttgttaaggatatatttgaagattggcttttccatattgtccttcattctttgaccgtggcaaagtgtacagtagattttcatgatcattgcatatttcttgtcattgaaatgtatcttttatgtttttaaatgcattcattttacacttgtgagtttatcattgactttaagaggtagaaatgaaaaatgaaaattaaagctaaagcctttttatctattaatgcagatatattagaataagaatattttgggtttgtgtttattttttaatgaatttatgtttacttgatatggaaaattacgctttataggtggaaaagtagcaaataaagattaagtaaaagtaagtgaaaatgatggggaatatagtattggaattttatagctagttaaaacaataagtatcatctaatttgggtgtttattttgcagatgagaaaacagacctagaaccgtggcatgttttgcctgaaacatacagtgagttagagacagggcctaagatagcttctagcatcagatcaatcccaagaatccatcagcaacctcagaccaacccaagaagataatttaaatctatactgcttattggtcaatatatttggttctagtattaataaagaaaaatgttattaaaatagcatacatagtagtaaaataaaatacaaaaagtgtgttgatttatagctgtttgagatgataaaagtgaagcaaagcctgttaaatcattggaagacttggaaaattattttaaataaacaattacatgtaaaaaaaaaaaaaaaaaaaaaaaaaaaaaaaaaaaaaaaaa

SEQ ID NO: 350 - DNA, 60 bp, Homo sapiens
gcaaagcctgttaaatcattggaagacttggaaaattattttaaataaacaattacatgt

SEQ ID NO: 351 - DNA, 3929 bp, Homo sapiens
gcagtcaggccgttgtgcgcaggcgcagaggcggcggcggcggcggcggcggcggatgtttacggcggccgaggttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgcatcctgtgtaggattccaattcttgaatatgttcttttcaaaatcttaagaaaagaaccttttttctttattaacatcatgtgtttactttcagcaaatatttgtattactgcttgattctgtgacagtcacaatagatgtagagaaggcattatttttcattaataaatgtgaaattggaatggaaaaaaaaaaaaaaaaaa

SEQ ID NO: 352 - DNA, 60 bp, Homo sapiens
gagctggtaaacacaaatcatgtcaataaaggtagtcaggatattttatccttagcattg

SEQ ID NO: 353 - DNA, 2970 bp, Homo sapiens
gttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccagggtcccccagggtgggctcagctccagggagaggccacccacgtggcagccccacctcttgagagcccccagtgccggagcagaaaggaccctggacccagaggcagatactgcggggtggtagaaaaggtagagtaggctgtggcaatggaataaaacacgattaaaaacgttaaaaaaaaaaaaaaaaaaaa

SEQ ID NO: 354 - DNA, 60 bp, Homo sapiens
ataattctctgtacaggggggtttgtgctatacactgggatgtctaattgcagcaataaa

SEQ ID NO: 355 - DNA, 1020 bp, Homo sapiens
ggccttccaaagtgctgggattacaggcgtgagtcaccgcgcccggccaaataaaataaaatgttaaagcaaattcaggactacccctcctccaagtcttctgttccctttgggcgcccaggtgagcgggggaggggctgggggagtaataacatcaaaagagcgccttttcctcccttattccgaggagacttccctgggcctgactcccggtcctgtccccagcgccccgcggcctctggagccccttcagtgaccaagatacagagatcaggacgcctttgcgccgccccaggtgcccgcccctagctggctctgcttgggccgcgagggaaggtgaggtcgggggcggagccggggcgtgacagccggggtgtgtgtccgccgggcttggtgcctccggtggccctgcagcaccgtcccacctctgccaccctccgatggggccgctacctgtgtgcctgccaatcatgctgctcctgctactgccgtcgctgctgctgctgctgcttctacctggccccgggtccggcgaggcctccaggatattacgtgtgcaccggcgtgggatcctggaactggcaggaactgtgggttgtgttggtccccgaacccccatcgcctatatgaaatatggttgcttttgtggcttgggaggccatggccagccccgcgatgccattgactggtgctgccatggccacgactgttgttacactcgagctgaggaggccggctgcagccccaagacagagcgctactcctggcagtgcgtcaatcagagcgtcctgtgcggaccggcagagaacaaatgccaagaactgttgtgcaagtgtgaccaggagattgctaactgcttagcccaaactgagtacaacttaaagtacctcttctacccccagttcctatgtgagccggactcgcccaagtgtgactgactaccttgacttgaaatgctcttttgcacaaggaaataaagcgtcctctcagtaatgaaaaaaaaaaaaaaaaaaaaaaaaa

SEQ ID NO: 356 - DNA, 60 bp, Homo sapiens
aagtgtgactgactaccttgacttgaaatgctcttttgcacaaggaaataaagcgtcctc

SEQ ID NO: 357 - DNA, 6826 bp, Homo sapiens
tggtcagccacccctggctggctccaggcccagctccccaatattccccactaggcctcagtgtgtcctcatttctatctgtacctttgccatcctgggccatgcaacctgtagctctcggcctcttctgtctcctttcaggctgagtctctgaatctgtctccatttgtgactctggtttccatgggatacatagatgtggagcctcaggagggcaggggtagtgtgatcagtgtcaggcgccccaaagcatttattctgtgccaggccctgtgctggatgctgaaagtacggaagtggataacatacagtctctgtttccatgaagcctacaatgcacattctctgtggagtggagaaaccagggcccagccctgcctctatctcagtatggctgtacctcccctgaatctgcctgctgtgcccagggtgccaggtcagctatagcctgtggcttgaggctcttctttgcctctggcattcacaggggtatgtgtgcccgccagcaggtcccccccggctcttagggctcctgggggacttggctggtgggtgctggtgggcagcagaaggggagggagggagcagaaggcagtgactcagtgggggtggccctgggacagaactggggaggaagccaaggttggatgatgcttcctgaagccaggagggtgggaagagaggtctggctgggagttagggatggagcaggacaactccaaggctcccctctggcagccagacctgctcatgaagaaggctcctcggtagctgcctgaaagtctggactctgggggctgggctgggctgggtggggagattgctgttggtcccactgtgcctgttgtaatccccaggttcatgaaagaggtgcctgccttagagccagggaagccgttgcacccggtgccccctctccccagggaccatgggcctgggcacactgtggggctcagggtcttctcctggtcgcagagctgaccttcccacaatcttcccacaaattctggggagtgtcgggccaggcccacatgccctaaagggacctcaaatcgcacagctacccacttgggtagctttcatcagttcaggattccctgactgcgggtgaaatgagggggcagggcaccaacacagcccgagtgctggcagcgggtgaacgtataacacagggagtcttccccagtcctcacggcaaccccaggagaaaaatgactttccatttttacaggtgaggagggtgaggctcaaagagcagagttcctggagcgcccccagcaggtaagtggagaagccaggcctgggctgggggctctggctccagaaccccacctcagcaccagcctcctgcaccggactttgtggagaagggggtaagggggtgccagggatggcaaaggggtagaggatctggtggactctggcaggcctgggtcagctccacccattggtctcactcccacccggatggcagccccatcccacgtgggatcatgcgacctgtctctgggtgcccgcggcgaggcagcaccccgcttccctacacagaaggccttcccctcccgtcggctcattcagccgcggaagcccctgggagaccccgccccgccccgtcccgcggtgccccccgcgcactcaccctcgctcacccacgcggccttcctggcgggagagcgcttccggcgtcctcgccaggcccggggagtgggcacggtggagctgccgaccgttggtcgctgccccaacccacgcactgcgacgccgcgggtgaggcgcgcggtctgcggggcccgggggtgcggcggggcggggctggcgggctgtccgggcccacggagaggacggcggcgggcgggggttgctgcagggcccgcaccttgtcttccgcgccggcagggctgtgccccgtcgagacctgctcgggctgtggctccgtcctccggcctccagggggcggcgcggcgctgcgcggcgccccggcggcactgccctcccttcccagcggccaggaggcggtgtcccgtgacgccgcgcggccgcgctgtagtggccgtcgaggccgccgtctgttcgaaggctgtccgacttcacggttccccgcggctcggcccgggggcgtgagtgtcgccagcgggcgacgggggggcgcgcggtaggccctgcaacaaggccagggcctgggggggccggcaggagagcgaacccgaggcatcgtggtgccatggcggggccgcccccacgggcatgggcctgcagagcgtggccgtgaggacgctgagggtgggcgcgcacggagcagaggcccacgggcgtccgacgggggacctggacagagggacacccttaacgttattccctcttcccaggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacagggtgagagtgacaccccaggggtagggttggtaggggacccaggtccaagcagggcgatgccatctggcttgagccctggggcattggacagcgaccctgtgggccttggagaccctttatcagaaatatcaaagctgctggaggcagcccccagtggatccggcctccctaagcctgctgactgcctcctggcccaagacctctgttgggagctgctggccagtggtatggccaccttgccagggactcgggatgtccaaggccgggcagtgctgcttctgtgtgcccacagcccagcctggcttcagtctgagtgcagcagccaggaactcatccgcctcctgctgtacctgcgaagcatccccaggcccgaagtacaggcactgggactgacagtgctagttgatgcccgaatttgtgctccaagttcttccctcttctctgggctcagccaactacaagaagcagccccaggggccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatatgtaaaaaaaaaaaaaaaaaaaaaaaaaaaaaaaaaaaaaaaaaaaa

SEQ ID NO: 358 - DNA, 60 bp, Homo sapiens
ctcttctgggtctccgctgtcccctgtatcccagcttcctagaggaagcagcactggagg

SEQ ID NO: 359 - DNA, 2965 bp, Homo sapiens
gccgggaactggaggaaggagaccctggcttcgcaggggccccggctggggcagaggcgaggggcctgggggggcgctggctttggccccgcctggggcaggatggtgaatctggagtccatgcacacagatatcaagatgagtggggatgtagccgattccacggatgctcgcagcactctcagccaggtggagccaggaaatgatcgaaatggcctagatttcaacaggcagattaaaaccgaagatctcagtgactccctgcagcagaccctctcccatcggccatgccacctgagtcaaggacctgccatgatgtccggaaaccaaatgtctgggctaaatgccagcccatgtcaggacatggcttccctccatccgctccagcagcttgtgctggttcccggccacttacagtctgtatcccagttcctgctatctcagacccagcctgggcagcaaggtctgcagccaaatctcctcccctttccacagcaacaaagcggtctcctcctcccacagactgggccgggactggcatcccaggcatttgggcaccctgggctgccaggatcctctttagaaccccacctggaagcatcccagcatctcccagtgcccaagcatctacccagctctggaggggccgatgagcccagtgacctcgaggagctggagaagtttgccaagaccttcaagcagaggcgcattaagctgggcttcacacagggagatgtggggctggcgatgggaaagctgtatggcaacgacttcagccagaccaccatctcacgatttgaggccctcaacctgagcttcaagaacatgtgcaagctcaagcccctgctggagaagtggctgaatgatgcagagtcctctccgtcagacccctcagtgagcacgcccagctcctaccccagcctcagtgaagtatttggtaggaagagaaagaaacggaccagcatcgagaccaacatccgcctgactctggagaagaggtttcaagataacccaaaacccagctcggaggagatctccatgattgcagagcagttgtccatggagaaggaggtggtgagggtctggttctgcaaccgacgccaaaaggagaagcgaatcaactgccctgtggccacacccatcaaaccacctgtctacaactcccggctggtatctccctcagggtctctgggccccctctctgtccctcctgtccacagtaccatgcctggaacagtaacgtcatcctgttcccctgggaacaacagcaggccttcatctcctggctcaggactccacgccagcagccccactgcatctcaaaataactccaaagcagcagtgaactccgcctccagttttaactcttcaggatcttggtaccgatggaatcattccacctacctccactgagaccaaaaagtttctcctactccagctggccctgtattccccctggaaggaagggaatcatgccttctatatacagacagattgccttcagaagagtggaagaaaatctccactatcaatgaacccagactcttgtcttcttcaagagcaagggcctccggagatccaaactgtgattgaaccaagtgcagactcctaatgctcttgaaatacacagcccctcctaggagcttaccattttcaccttccttgcctatgcccttgccttctagttccaaatattttagccagcttcactgtggcaatagtctttcagagaaaagacttcttgctgttattctccaactcatccgtgggcttctggggacagccatttggctggggtgccaaacaccagaaggggagataatagttttgactctgaacttggccacaacccctgaactgatcccaaaatctgtgaaaagatttgaatctgatatctccaccaaagccttgatgttttctctgtacagctaagttttctgatggaatcttcatctcaccccattttctttttaacctcgcccccttttctacaatcaaatccattcattattgcgccctccaggtcccctcctttttgcagaaggtgtaaaagagctgcccttggtgggtgccctgggcatgttgcaacgcctgctggtgcccttctgtctgtccacgtctgcctagggctcaggagtgcttgttctttcccttcctccctgtgtttctctttatcctgtcccctctcctttctcctggcagcagaaaaggaagaacacaagagcaaacacacaacaatgatggtggcaaagtacctgtatatagccctttcccattttttgcattatgttcttaactccttaatgtggaattttccagcaaaatgtttaactcaggtgtgatttttgaaaatgtctctgtaatattttatcttctttaaaaaaaagggggggaaataccaaagtgtgaaatactgtgctaccttccagagttcccacatgggctgggatttttttttctttttcttttttttttttttttttgagacagtcttgctccagcccaggctggagtgcagtggcatgatcttggctcactgcatgctctgccacttgggttcaagcgattctcctgcctcagcctctcaagtagcgggattacaggcgcccaccaccaaaaattagcccagctaatttttgtatttttagtagagatggggtttcaccatgttggtcaggctggtcttgaactcctgacctcctgatccacccacctcagcgtcccgaagtgctgggattacaggtgtgagccaccgcgcctggcctgggctgggaatctttgttgacttctttgggaacattatctctagagtctgcttttttgtgggccagtttgtagagatgtaacatgaagccattccagaaatggtaacttaaaaaaaaaaagactacatgtctaggaaactgttgagattcaaaggaatctcactgttcctaaataaatgtgtatagtgattatgaaaagt

SEQ ID NO: 360 - DNA, 60 bp, Homo sapiens
agactacatgtctaggaaactgttgagattcaaaggaatctcactgttcctaaataaatg

SEQ ID NO: 361 - DNA, 922 bp, Homo sapiens
gcggccgccgcctcccaccgctcccgcgcccgctcccgcccccggcgcgtctcctccgggcccgcgccgcggcgggctcagtcctcagcggggcgcgtggcgagcggactcgactcggcaccgctgtgcaccatggcccgggccctgtgccgcctcccgcggcgcggcctctggctgctcctggcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgaccttgacttacctctggaaagggtcccagcctagactgcttaccccatagccacatttgtggatgagtggtttgtgattaaaagggatgttcttgaacttggaaaaaaaaaaaaaaa

SEQ ID NO: 362 - DNA, 60 bp, Homo sapiens
ctgcttaccccatagccacatttgtggatgagtggtttgtgattaaaagggatgttcttg

SEQ ID NO: 363 - DNA, 4700 bp, Homo sapiens
atggccccctcggcctgggccatttgctggctgctagggggcctcctgctccatgggggtagctctggccccagccccggccccagtgtgccccgcctgcggctctcctaccgagacctcctgtctgccaaccgctctgccatctttctgggcccccagggctccctgaacctccaggccatgtacctagatgagtaccgagaccgcctctttctgggtggcctggacgccctctactctctgcggctggaccaggcatggccagatccccgggaggtcctgtggccaccgcagccaggacagagggaggagtgtgttcgaaagggaagagatcctttgacagagtgcgccaacttcgtgcgggtgctacagcctcacaaccggacccacctgctagcctgtggcactggggccttccagcccacctgtgccctcatcacagttggccaccgtggggagcatgtgctccacctggagcctggcagtgtggaaagtggccgggggcggtgccctcacgagcccagccgtccctttgccagcaccttcatagacggggagctgtacacgggtctcactgctgacttcctggggcgagaggccatgatcttccgaagtggaggtcctcggccagctctgcgttccgactctgaccagagtctcttgcacgacccccggtttgtgatggccgcccggatccctgagaactctgaccaggacaatgacaaggtgtacttcttcttctcggagacggtcccctcgcccgatggtggctcgaaccatgtcactgtcagccgcgtgggccgcgtctgcgtgaatgatgctgggggccagcgggtgctggtgaacaaatggagcactttcctcaaggccaggctggtctgctcggtgcccggccctggtggtgccgagacccactttgaccagctagaggatgtgttcctgctgtggcccaaggccgggaagagcctcgaggtgtacgcgctgttcagcaccgtcagtgccgtgttccagggcttcgccgtctgtgtgtaccacatggcagacatctgggaggttttcaacgggccctttgcccaccgagatgggcctcagcaccagtgggggccctatgggggcaaggtgcccttccctcgccctggcgtgtgccccagcaagatgaccgcacagccaggacggccttttggcagcaccaaggactacccagatgaggtgctgcagtttgcccgagcccaccccctcatgttctggcctgtgcggcctcgacatggccgccctgtccttgtcaagacccacctggcccagcagctacaccagatcgtggtggaccgcgtggaggcagaggatgggacctacgatgtcattttcctggggactgactcagggtctgtgctcaaagtcatcgctctccaggcagggggctcagctgaacctgaggaagtggttctggaggagctccaggtgtttaaggtgccaacacctatcaccgaaatggagatctctgtcaaaaggcaaatgctatacgtgggctctcggctgggtgtggcccagctgcggctgcaccaatgtgagacttacggcactgcctgtgcagagtgctgcctggcccgggacccatactgtgcctgggatggtgcctcctgtacccactaccgccccagccttggcaagcgccggttccgccggcaggacatccggcacggcaaccctgccctgcagtgcctgggccagagccaggaagaagaggcagtgggacttgtggcagccaccatggtctacggcacggagcacaatagcaccttcctggagtgcctgcccaagtctccccaggctgctgtgcgctggctcttgcagaggccaggggatgaggggcctgaccaggtgaagacggacgagcgagtcttgcacacggagcgggggctgctgttccgcaggcttagccgtttcgatgcgggcacctacacctgcaccactctggagcatggcttctcccagactgtggtccgcctggctctggtggtgattgtggcctcacagctggacaacctgttccctccggagccaaagccagaggagcccccagcccggggaggcctggcttccaccccacccaaggcctggtacaaggacatcctgcagctcattggcttcgccaacctgccccgggtggatgagtactgtgagcgcgtgtggtgcaggggcaccacggaatgctcaggctgcttccggagccggagccggggcaagcaggccaggggcaagagctgggcagggctggagctaggcaagaagatgaagagccgggtgcatgccgagcacaatcggacgccccgggaggtggaggccacgtagaagggggcagaggaggggtggtcaggatgggctggggggcccactagcagcccccagcatctcccacccacccagctagggcagaggggtcaggatgtctgtttgcctcttagagacaggtgtctctgcccccacaccgctactggggtctaatggaggggctgggttcttgaagcctgttccctgcccttctctgtgctcttagacccagctggagccagcaccctctggctgctggcagccccaagggatctgccatttgttctcagagatggcctggcttccgcaacacatttccgggtgtgcccagaggcaagagggttgggtggttctttcccagcctacagaacaatggccattctgagtgaccctcagagtgggtgtgtgggtgcgtctagggggtatcccggtagggggcctgcagggagccagagggtggaaatggcctctaagctagcaccccgtaagaagagcctacctgaccgacttggggagggaacacagaggtgttgggaaggtggagcaacaatgcacctcccctcctgtcgcgccgtgatatcttggtggctccctgccactgcccaccgcctcttctccatctgagaatcacggagaggtgtagataatctagaggcatagactgctagagcccccagggatctggggtggtcagggctcaggcttcactttgtaaaccaggtgggggcatctcacagcctgacttcccttccccaggccagggttgctgggatgcctgcccctcctgagaggaccccctccccattgtcaggctctccatgtccacgagcggggaggggtgggttctggggcattgttgtcccttgtgtctgtggactagagatagggtgggggagctggggaagggtgcaggcgggaagagtgggctgtctttcccagggtgatgcaagcatgccgcagccctggaggctgggaatgtggaggctctgtgagccctgcagccctcagaatcagggccagggatgcagaagattgagaggatatggagatggatagagggcaggagacccttaggatagattgtgggacccaggcaggaacaggtgtccacaagaactcaggatggcatcagttagctcagaagccacctggaagacccagtgtttccatctctggaatctctgttttatgctaaatggatttaggaagactgtttttcttttaagggggaaacaaggtagagaaaaggacgaagaagtgtaagtcccgctgattctcgggggtaaggctcggatggcaaggacgcgttctgcctgggcatgtaggggaggtgtttttgccatcaccagtttctcaggctggggagcacagaggggaggaggaggactaaatgaaaagttgttcccagcctgcacatgaacacattcatgacacacaaaactggctggaaggagataagagcactgggtttgagattccctccattaaaacaaccaagacaaagaaaggaggggaaaaaaagataaaaagcaagccagggttccctgccctattgaaactcaaacccagactgccttgggttttatctttcccttacccctggcacctccagagaactgggacctgaaatagtccctccgttctcccctttgaccatgtaataaatgaaccagaagcactgagattaacctatcaacgccctgagaagccttccagcctgcggtgctgtctgctgggaggtcagctggtcaaggcagaggaggagaggaggaaaggatgggggctgaagagcagaagggaggggagacagaggggattaaagaggggaggagagagtgcagagctccaggaaagggtatcagagctgcagccagctctgccctctaccctagggaggccagaaagacacaaacagccctccgggcctttacgctggactctggcttggcaggctccaggcagggtcctctgggaagttactctagaaaacgaagggaggaggagcacaagatcctcagcaacgaacacctgcacttagaaaaagtggacagcttctgccaaccacaccctacccatggtactgtatgctattaactcctggaaacgccccgtaaatgcgagttgtttttgtatttgtgtgttgagatgggccttgtggtttctctgtactcagagcacatttcttgtaattactattgttatttttattgtcatgactgcccctgagctctggtgagaaaagctgaatttacaaggaaagggatgaagttaatatttgcatcacataattatatcattactgtgtatctgtgtattgtactaaatggactgatgctgcgcacatgagctgaaaatgaagagccctcccatcc

SEQ ID NO: 364 - DNA, 60 bp, Homo sapiens
gctctggtgagaaaagctgaatttacaaggaaagggatgaagttaatatttgcatcacat

SEQ ID NO: 365 - DNA, 2164 bp, Homo sapiens
ataaatatcagagtgtgctgctgtggctttgtggagctgccagagtaaagcaaagagaaaggaagcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaaagctgaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 366 - DNA, 60 bp, Homo sapiens; identical to SEQ ID NO: 56

SEQ ID NO: 367 - DNA, 3919 bp, Homo sapiens
gccgccgccaccaccgctgccactgccgccctgccggggccatgttcgctctgggcttgcccttcttggtgctcttggtggcctcggtcgagagccatctgggggttctggggcccaagaacgtctcgcagaaagacgccgagtttgagcgcacctacgtggacgaggtcaacagcgagctggtcaacatctacaccttcaaccatactgtgacccgcaacaggacagagggcgtgcgtgtgtctgtgaacgtcctgaacaagcagaagggggcgccgttgctgtttgtggtccgccagaaggaggctgtggtgtccttccaggtgcccctaatcctgcgagggatgtttcagcgcaagtacctctaccaaaaagtggaacgaaccctgtgtcagccccccaccaagaatgagtcggagattcagttcttctacgtggatgtgtccaccctgtcaccagtcaacaccacataccagctccgggtcagccgcatggacgattttgtgctcaggactggggagcagttcagcttcaataccacagcagcacagccccagtacttcaagtatgagttccctgaaggcgtggactcggtaattgtcaaggtgacctccaacaaggccttcccctgctcagtcatctccattcaggatgtgctgtgtcctgtctatgacctggacaacaacgtagccttcatcggcatgtaccagacgatgaccaagaaggcggccatcaccgtacagcgcaaagacttccccagcaacagcttttatgtggtggtggtggtgaagaccgaagaccaagcctgcgggggctccctgcctttctaccccttcgcagaagatgaaccggtcgatcaagggcaccgccagaaaaccctgtcagtgctggtgtctcaagcagtcacgtctgaggcatacgtcagtgggatgctcttttgcctgggtatatttctctccttttacctgctgaccgtcctcctggcctgctgggagaactggaggcagaagaagaagaccctgctggtggccattgaccgagcctgcccagaaagcggtcaccctcgagtcctggctgattcttttcctggcagttccccttatgagggttacaactatggctcctttgagaatgtttctggatctaccgatggtctggttgacagcgctggcactggggacctctcttacggttaccagggccgctcctttgaacctgtaggtactcggccccgagtggactccatgagctctgtggaggaggatgactacgacacattgaccgacatcgattccgacaagaatgtcattcgcaccaagcaatacctctatgtggctgacctggcacggaaggacaagcgtgttctgcggaaaaagtaccagatctacttctggaacattgccaccattgctgtcttctatgcccttcctgtggtgcagctggtgatcacctaccagacggtggtgaatgtcacagggaatcaggacatctgctactacaacttcctctgcgcccacccactgggcaatctcagcgccttcaacaacatcctcagcaacctggggtacatcctgctggggctgcttttcctgctcatcatcctgcaacgggagatcaaccacaaccgggccctgctgcgcaatgacctctgtgccctggaatgtgggatccccaaacactttgggcttttctacgccatgggcacagccctgatgatggaggggctgctcagtgcttgctatcatgtgtgccccaactataccaatttccagtttgacacatcgttcatgtacatgatcgccggactctgcatgctgaagctctaccagaagcggcacccggacatcaacgccagcgcctacagtgcctacgcctgcctggccattgtcatcttcttctctgtgctgggcgtggtctttggcaaagggaacacggcgttctggatcgtcttctccatcattcacatcatcgccaccctgctcctcagcacgcagctctattacatgggccggtggaaactggactcggggatcttccgccgcatcctccacgtgctctacacagactgcatccggcagtgcagcgggccgctctacgtggaccgcatggtgctgctggtcatgggcaacgtcatcaactggtcgctggctgcctatgggcttatcatgcgccccaatgatttcgcttcctacttgttggccattggcatctgcaacctgctcctttacttcgccttctacatcatcatgaagctccggagtggggagaggatcaagctcatccccctgctctgcatcgtttgcacctccgtggtctggggcttcgcgctcttcttcttcttccagggactcagcacctggcagaaaacccctgcagagtcgagggagcacaaccgggactgcatcctcctcgacttctttgacgaccacgacatctggcacttcctctcctccatcgccatgttcgggtccttcctggtgttgctgacactggatgacgacctggatactgtgcagcgggacaagatctatgtcttctagcaggagctgggcccttcgcttcacctcaaggggccctgagctcctttgtgtcatagaccggtcactctgtcgtgctgtggggatgagtcccagcaccgctgcccagcactggatggcagcaggacagccaggtctagcttaggcttggcctgggacagccatggggtggcatggaaccttgcagctgccctctgccgaggagcaggcctgctcccctggaacccccagatgttggccaaattgctgctttcttctcagtgttggggccttccatgggcccctgtcctttggctctccatttgtccctttgcaagaggaaggatggaagggacaccctccccatttcatgccttgcattttgcccgtcctcctccccacaatgccccagcctgggacctaaggcctctttttcctcccatactcccactccagggcctagtctggggcctgaatctctgtcctgtatcagggccccagttctctttgggctgtccctggctgccatcactgcccattccagtcagccaggatggatgggggtatgagattttgggggttggccagctggtgccagacttttggtgctaaggcctgcaaggggcctggggcagtgcgtattctcttccctctgacctgtgctcagggctggctctttagcaatgcgctcagcccaatttgagaaccgccttctgattcaagaggctgaattcagaggtcacctcttcatcccatcagctcccagactgatgccagcaccaggactggagggagaagcgcctcaccccttcccttccttctttccaggcccttagtcttgccaaaccccagctggtggcctttcagtgccattgacactgcccaagaatgtccaggggcaaaggagggatgatacagagttcagcccgttctgcctccacagctgtgggcaccccagtgcctaccttagaaaggggcttcaggaagggatgtgctgtttccctctacgtgcccagtcctagcctcgctctaggacccagggctggcttctaagtttccgtccagtcttcaggcaagttctgtgttagtcatgcacacacatacctatgaaaccttggagtttacaaagaattgccccagctctgggcaccctggccaccctggtccttggatccccttcgtcccacctggtccaccccagatgctgaggatgggggagctcaggcggggcctctgctttggggatgggaatgtgtttttctcccaaacttgtttttatagctctgcttgaagggctgggagatgaggtgggtctggatcttttctcagagcgtctccatgctatggttgcatttccgttttctatgaatgaatttgcattcaataaacaaccagactcagtt

SEQ ID NO: 368 - DNA, 60 bp, Homo sapiens
tggttgcatttccgttttctatgaatgaatttgcatacaataaccaaccagactcagtaa

SEQ ID NO: 369 - DNA, 7697 bp, Homo sapiens
agaatgggaaactgccttgggagaagccccaagtgagcccaagggcgcagagcagaaggaccctggagtgtaagagcctagattgcaagcctggcaggaggagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggcagagttggaccagctgctcagtggctttggcctggaagatcctggaagctccctcaaggaaatgactgatgctcgaagcaagtacagtgggacccgccacgtggtgccagcccaggttcacgtgaatggagacgctgctctgaaggatcgggagacagacattctggatgacgagatgccccaccacgacctgcacagtgtggacagccttgggaccctgtcctcctcggaagggcctcagtcggcccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtgagccgctgccctgcagacaatcctggcctcgtccaggcccagcccagagtgccactcacccccacccgagggaccagcagtagggtggctgtccagaggggtgtaggcagtgggccacatccccctgacacacagcagccctctcccagcaaagcgttcaaacccaggtttccaggagaccaggttgtgaatggagccggcccagagctgagcacaggcccctccccaggctcgcccaccctggacatcgaccagtccatcgagcagctcaacaggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggctcctctgctgaacagcccctgggcgggagactcaggaagctgagcctggggcagtacgacaacgatgctggggggcagctgcccttctccaaatgtgcatggggaaaggctggtgtggactatgccccaaacctgccgccattcccctcaccagcggacgtcaaagagacgatgacccctggctatccccaggacctcgatattatcgatggcagaattttaagtagcaaggagtccatgtgttcaactccagcatttcctgtgtctccagagacaccgtatgtgaaaacagcgctgcgccatcctccgttcagcccacctgagcccccgctgagcagcccagccagtcagcacaaaggaggacgtgaaccacgaagctgccctgagacgctcactcacgctgtggggatgtcagagagccccatcggacccaaatccacgatgctccgggctgatgcgtcctcgacgccctcctttcagcaggcttttgcttcttcctgcaccatttccagcaacggccctgggcagaggagagagagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcggcctcacctctgccagatagtccaggtgataaacttgtgatcgtgaaatttgttcaagacacttccaagttctggtacaaggcggatatttcaagagaacaagccatcgccatgttgaaggacaaggagccgggctcattcattgttcgagacagccattccttccgaggggcctatggcctggccatgaaggtggccacgcccccaccttcagtcctgcagctgaacaagaaagctggagatttggccaatgaactcgtccggcactttttgatcgagtgtaccccgaagggagtgcggttgaaagggtgctcgaatgaaccatatttcgggagcctgacggccttggtgtgccagcattccatcacgcccttggccttgccgtgcaagctgcttatcccagagagagatccattggaggaaatagcagaaagttctccccagacggcagccaattcagcagctgagctgttgaagcagggggcagcctgcaatgtgtggtacttgaactctgtggagatggagtccctcaccggccaccaggcgatccagaaggccctgagcatcaccctggtccaggagcctccacctgtgtccacagttgtgcacttcaaggtgtcagcccagggcatcaccctgacagacaatcagaggaagctcttcttccggaggcattaccccgtgaacagtgtgattttctgtgccttggacccacaagacaggaagtggatcaaagatggcccttcctcaaaagtctttggatttgtggcccggaagcagggcagtgccacggataatgtgtgccacctgtttgcagagcatgaccctgagcagcctgccagtgccattgtcaacttcgtatcaaaggtcatgattggttccccaaagaaggtctgagaactcccctccctccctggacccaccgatgcctctcgaagccctggagacagccgttgggtgagggtggggcccccactttttaccaaactagtaaacctgacattccaggcccatgaggggaaagaggatcttccagctctgcaaaaacaagaacaaacaacatcaccgtgaattggcctttcctgaaagtgacttatctgacacatctctgtagccacatgctttttgggtagaagaagctgggcatgggtgcaccccaccccctagggtccccatgggaaagggacatgcaaggaaacagcacagaacacgaggtggtccccatgtccctggcacactagcattccgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctaacgaaactgagaagggggcgtatgtttgacgaaggtttgtgcaagtcaggcccttctggaacacagcagggcctacaacgaggggcctttgcgatgggctgtgaggatgggggtggtgggaagaattggccacgttggagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaactcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggtaaaaaaaaaaaaaaaaaaaaaaaaaaaaaaaaaaaaaaaaaaaaaaaaaaaaaaaaaaaaaaaaaaaaaaaa

SEQ ID NO: 370 - DNA, 60 bp, Homo sapiens
gccatgttaaaagtcactgtgcatttattctcagcatcaaataccttgtaacgtcttctc

SEQ ID NO: 371 - DNA, 9351 bp, Homo sapiens
aaccgtccccaacggtcgccagcgcgcggctcccgggccccctcgctcctcccctctggcccctccgagcgctgggggtgcttccctccccgcctcctcgcactcccactcgcgggcacgccggtggctgtgccgccatgccccaccacaggctgctcacgggcctaggcgcggcggcccgagataggggcccctgagcctcccgggggaggagagaggcagcgagccgcgctccgccccctccccccgggccgccgccgccgccgcctcgccgccccagcctggcgggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtatccctaccaactctacattgctccttccaccagcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaagtgatttcctagtaccggactacttaaaccaggaacaagaagagacccttgttcaatatgatcttggagaacacggttttgaaagcaactcctctgttcaaatgcctgtcatttcacaggtctcctcaacccagaattgtgaaagcacttttcccttggggtctcttggtgggctggcagaaaaagaggaagaagtgccagagcagccaaagagcagtgcttgtgctgaggcaaccagagatgaccccccaaaatcagagctgtcttctataactattgagtagttttgtgatttggcttcagttttgttttttggaaagtgcctgtgcttggtcttgtacatttaaatttaatttaattttttaaacaaaaaaagccgggtgggagggagggggagattgggaaagaatttccctttttactttctgagccctgaaactgattttatttttcctaactgagagattgcttctgtaagtacacaataacatgatgttgaaacagaaactatgagacttaaggagaactggttgacttaaaacatataccagttccttcttccattgttaaaagtaggctaacaacagatcattagctagagaggaaatcagatgattattgaccttcttgagacaagagggtacatgagaaactaattactaaacagcttgacaaatggcctgagtagatacttactgctgtacacaggatgttgtataatattttgtaaagcctgttgtttttggaagtatttatggtaagctttcttaaaaattattatggtaaatacttctgaaatccggcgtacttttctttaagctttgtcatttctgttatgatttttcatggtgaaattttggtactgagatgggcattctctgtacctttatagtaccactccaaaggcaaggaaccatgattgacaacagtcaagctgtggatgaaatgaccaggaacggagaatgaagtatgtaaatcccagcttcataggaactcttctcatactgcttttcagattaaaattgctgtttacctggtctccgaatgtaatgcctgactgtgtcattgcccggatcagttttccccctgccccatcaatatgttctcttgcatatattggcgtgctgccatataaagtaaaaatactggagatattctatattttatatataggtttatgtgttgttggggatgttttcattgtgctcttttggacataataaataattctctattgaggctacattctttttttttttctttttttttaaaagaatggcatctcactctgttgcccaggctggagtatagtggctaagtcatagctcactgcagcttcgaactcctgggctcaggccattctcctgcctcagcctcttgagtatctaggattataggcatgctccaccacacctggttaacttcatttttattttttgtagagatgaggtctcactatggtgcccaggctggtcttgaactcctagaccaagtgatcctcctcctttggcctcccagactgctgggatcactgcaccggccaaggctgcattcttaacccaactagattgtttactgaatcccatatgacagcgatacattgtccttacatatttatttttagacattgcaaagttattaaaaacagttaactatagtttttacacaacgtaggcaacaatgaagagtatagactgtaagattttcatctatgactcataaatctgggagaaaaaaattattaagactaatgagaaactgaaaaccttaaactaatgaatattatttctgctgctaaaaatatgaaactttctggtctgtagttgaaatttgtatgatcctctagacttgggtatacttttcatctggtgccattaaagcatctctaatattgatcctaaatatttgtaagtccatgagcagtgaactttggaataagtttctgtgtagatacccaaagtttaataattatgagagcacctgatttgatagacagaaaatacagttctttagtcaaaacacaagatctgaattttgttcaggtgctagaccatactaaatgtatatatttttaattatagtgatttgtttcatttttttagattggctaattctgtaattttttccccaaaaacatgtgaagaaaggaaaagtaaattaaattccttagaactgttttaggttaagattctctgtgtctgcccatattctgcagtccttaacttgttttcaactctttacctcactcatgaacttgtttttacccatttgctgccaaacataggtgtgttcccttcaggagaatcagcatatacaggttatgataggctcccaccatttatgcttcttcactgatagggttgcattactttctgcagcagactataatacttcatatagtactgctgtgtctcaactggaaaggtcaggaattttaatgttacgttgtggtctttgaaaactgttaggcctagcaatagataaatctcaaaattaattttaaaatctgtattgacaagaataggtaaaattatgaccaggaatcattgttacccttagttccaagaggtggtttttgaaagagcaagaggaaagaaaaaagaaaagaaggaaagaagaataaagaagagaaacgtgtaagaatggtttgcagattgattggttaaaagtgtttttagcacatccccaaccctgaaaacttcgcattaagagccaagcacaatgttggtagctccaagatattctgactgtgttctcagaatgagggattacccatcactgggtattccttcccaagtagaaactttagattttcactggtaatacacattgccaagttttatgggaaatctgaatatactgtgaaaatgcatatctggttagttgtctgctgcccagatcttatcaataccagtaactaaccagtatttaacataaaatgatacaaataaaggcctttttctatttcagtgagggtacatttttcttgatatatatgtactttaaggatattggatctgtttatggatctgttttaggaaacagatttgcaagggataattgtatatatagtagtatttaggtttatttcaaattcatcttagggatgcctagatgcataatttttaccaggacatattgaaaatattgcaaagagatagccagttatattatcccattcattagaaattaccagtgtaactaaacataaatattccagtttagagtgcttaaacgtagctatctttcttaaggccaggagggtaactttgtggtatctaaagggcttaaatttcagaatgcagaataaattgcctttttaaaaccaagcattttgtacaagcttttattttcagttttttaactaccaaataggtgtgatgtactttagaagtaaacaaagatgttcacccatgataatggatgttaaagctcctgcagttgttcttttcgtgtttaaagggtatattctaatagtggaagcatcaaacatgtcagtgatttcatctcattcagaaataaagagattaatattggtctttattttttggcattttaagttttatataaatggatgcagatggagattatcacccacaaatatatttaaatggatttttcttaatttgaatttcaagtaatctttttatttcaagtaattagttacgcatttagttacattgccagttttttttttttatcaatttcagtaagacaaaatatactaaaatgtttaaatagcctcattcaatcttacattttgacatttcagcaatcattctggcttacagtaattagatcccctgttacgacacatgccctttgttcttaataactagcaaaaaaaaaaaaaaaaaaaaactttcatcttgttaaaatactttgccaaatgaaatagactagtcaatacatctgatgtccataattattggtaactcagttaccttctaactaataggctggttcaggagactctcccagtttataaatggttctcttgggagcctttggaagctgtattaaatctttcagtcttttatttctaattttttctcttaatctaaatagaggccagttatctattttatcagcttttattcttgaagattctcagattatgttttagtcccttttagctttaatagtccttgaaaaatacattactgtataatgtggcaattctgtaacagagacttattacttgaatgaataatcctaaaattttaatattttagctgaagtttgagatttgtggaatgaacaaaagaattagaaactttcatatgttactttgtttcagtcatctgcaaagtatgaagctgtaattctgaaatacacatccaagtgaatgagaattaaaaattttctaaatattaatactaactgggaaaaaaaaactagtgtgaagtttacagttagaagaaacagacccaaagttgccagaaggtaataaataaatgtagttttcactgtaagtaagttattgacgtaagatgctttatttgtaatatatttagattttgaaagttattgagagatgaatgtataaaagctaaattttcttttctgaagcagtgaaacaaaattggggtaacaaggaagctctgttgtggcaaacatgtctatgaggaatattaaaactaagcatactcccacaggctttaaactcaaactatgaacatttaaattaagttgttccttattttgcctatacccatttttatctttcattgtcgtttttgcttgacagtatggtgacagagtatttttatttggaaagtcctcagcaagatgaattagccaaaagcaataatggttcagattaaacaataaagtggaattgattcaatcccaggctcaactaagaacagtcgctctctggatgtttcattttagacgatagataagttgagatgttgtaatatttatggggggttaagcctgtgtcagttatgggatgaagacttgtagtaccagtaccatcagtggtcatacttttttttaactttttactaaactaatacagttagacatttccactctatcgtgattatatttttatgatgggaaaataaaaacacttccatgtttttataaatagtctctgcaaagatttcagatgttattggtatctcggtttggcagtatctgaaaaattgagattgtctttgaaatgtttgtgctacttttacttaagtaaacccccactgtgcaagacccaggccggcttcagctaataccaaggtttctgtgtgcataatagtttacagagaacttaagagtaaggactgcggattaaaaacaaaactttttttaactttaaaatttttagtttttgttcaaagtacctggtttataaagtcaaattcttttattagttcctttctcgtttaaattgactgatgttgctgatgaagcttaaagtcccaggcacggttgtggcgatatactgataaaattggtgcctagtggtgggaggagctccagtgtcaggacttttattaaaaggcccttgttttcccaaatgccaatctagccacatttagatttcattattcaataaaacagatgaaaaatcatcccataaatgaatgttgaggttaccaaagtacatcacctgctgaggaaggataaatcttcctgctttaagggagccctgtcatctctcctcttaatgcacgtttcccttggtattagtggaagctgtgttcaagatgggaagcctttcctgcagttcttagaaacacctgctttctaaggagagccttttctaggattagcttatgtgtgttttctctaggcgattttttatttcagttaccaatttaattttcaagttgacagatgctgtgtaaagtctctcataatgagagtagtccattaaattgttgaaagttgcactgcttttcatctttcaggtacctgaaatgagtgacatcaggtatttggaaggagtaagatcataaactgtattcattttcttccttgtacaaagtgatgacttctaatgcttatatctcaaggtattttttaaaaaagcaacggtccctaatagagtaaaatttggttttggtccaagttcccaataatgtatttaatgtttctgttgtttactggtgcctcccgttgcatcaggtagagattgcctgcctctttgtagggcagccttgtggcaccttatgtccaacttggaggatagtatatggcttctttgtgcctctactatcttttcaaaagccattttataaaaatcctaggtagcctattttaatatttaaatatatatatttgtgaaagaacttttagaacagaccttttctttttactttaaaattcctgtatttccatttttaagagtaaatttaatctccaggatttagaagtgtctttccagagaagcataatgagaaagtcagactgaggtaataagaccagaattaagtgatagaagaaactgttgtttggttaaaggacacagatttgaaggaaaaaaattttgatgtaacaattttttaaataaaattttgtttttctgtaatgtcatatttgctgctacagtagctcaatattttacagggctaacataaagctggctccatttaaaaactggagtacttcctagtgcagccagcctaggcggaaactgtacaccatggtcttccagatgggtgactgatggctttgggtagctgatgcatgctttaatatttgcctatagcccggcagcaaggaagtcggggcggggggacttttttaccctgccagttatagcattgtgattctttctgggcactggcattttgtgaaactctcaagggaaggtgatgcaggggagaaaatgtgaattaaattacatagatgggtgtttttatgtcttctacccctttcctagaattagtacaactcttaactgtgccagtccccagttcaccagctttgtatccagtcgtcatctcattcaagtatggctttacttggtgacactggccatagctaagttaacttggcatgtttgacttttgacaataacaaaaatggttttggattttgttttatttccaaaaaatgtatacaatatcagaacttcacattttatatactagtatctggctattagtattttacaggaaccatagttcttggtgactacatatatatatatatttttgtgaccttttttgtaaactaagtgccgtttcaacgttacaatcatttttagggttattgtaatcaatgtgaatatcatgttttttcaaatctgttctgagcctatagtgtttgctttgtgaacatgtgtattgtatatattctgtatagttatattgtactgaaattagcttgtttgatataaggaaaatatgtattgagtacctttttgctagcctgattgtttaatctttttaaaaaaggtttaaactttttttaaaaaaaaaatctttaaactggcctttattacatggtcacacataaagttgcagttaggaaagggatgggcagggaaaaactagttttgagtgtctttagatagaaacatgagactaaggtttgattttgttttcgttttctcattaaaatatcttatgctttatggaataaaaaaaaaaaaa

SEQ ID NO: 372 - DNA, 60 bp, Homo sapiens
cagtactaacatagcatttcgttacctcttaagggttgagtttacaactccaaattcaag

SEQ ID NO: 373 - DNA, 2728 bp, Homo sapiens
atcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaagtgatgaaaataaattaaaactgaattacaaaaaaaaaaaaaaaa

SEQ ID NO: 374 - DNA, 60 bp, Homo sapiens
tctgattactcgcattctgtttcttgctttaaaagaagagtaaagacaagagtgttggac

SEQ ID NO: 375 - DNA, 5537 bp, Homo sapiens
cttttctttgcctctgcagcggccaagggggcgggccctgcagcctttgttgcccgcggaccgagcgcagccgaacggagtcggggccgggtcgccgggagctgcacgccggccgggcatgtcctgagccggacctgggaccaggcagcgaccggacgggacggacgagagcgtgcgcgcggggtcacccggcggccgcccggttcctgccatgcccggcggccccagtccccgcagccccgcgcctttgctgcgccccctcctcctgctcctctgcgctctggctcccggcgcccccggacccgcaccaggacgtgcaaccgagggccgggcggcactggacatcgtgcacccggttcgagtcgacgcggggggctccttcctgtcctacgagctgtggccccgcgcactgcgcaagcgggatgtatctgtgcgccgagacgcgcccgccttctacgagctacaataccgcgggcgcgagctgcgcttcaacctgaccgccaatcagcacctgctggcgcccggctttgtgagcgagacgcggcggcgcggcggcctgggccgcgcgcacatccgggcccacaccccggcctgccacctgcttggcgaggtgcaggaccctgagctcgagggtggcctggcggccatcagcgcctgcgacggcctgaaaggtgtgttccagctctccaacgaggactacttcattgagcccctggacagtgccccggcccggcctggccacgcccagccccatgtggtgtacaagcgtcaggccccggagaggctggcacagcggggtgattccagtgctccaagcacctgtggagtgcaagtgtacccagagctggagtctcgacgggagcgttgggagcagcggcagcagtggcggcggccacggctgaggcgtctacaccagcggtcggtcagcaaagagaagtgggtggagaccctggtagtagctgatgccaaaatggtggagtaccacggacagccgcaggttgagagctatgtgctgaccatcatgaacatggtggctggcctgtttcatgaccccagcattgggaaccccatccacatcaccattgtgcgcctggtcctgctggaagatgaggaggaggacctaaagatcacgcaccatgcagacaacaccctgaagagcttctgcaagtggcagaaaagcatcaacatgaagggggatgcccatcccctgcaccatgacactgccatcctgctcaccagaaaggacctgtgtgcagccatgaaccggccctgtgagaccctgggactgtcccatgtggcgggcatgtgccagccgcaccgcagctgcagcatcaacgaggacacgggcctgccgctggccttcactgtagcccacgagctcgggcacagttttggcattcagcatgacggaagcggcaatgactgtgagcccgttgggaaacgacctttcatcatgtctccacagctcctgtacgacgccgctcccctcacctggtcccgctgcagccgccagtatatcaccaggttccttgaccgtgggtggggcctgtgcctggacgaccctcctgccaaggacattatcgacttcccctcggtgccacctggcgtcctctatgatgtaagccaccagtgccgcctccagtacggggcctactctgccttctgcgaggacatggataatgtctgccacacactctggtgctctgtggggaccacctgtcactccaagctggatgcagctgtggacggcacccggtgtggggagaataagtggtgtctcagtggggagtgcgtacccgtgggcttccggcccgaggccgtggatggtggctggtctggctggagcgcctggtccatctgctcacggagctgtggcatgggcgtacagagcgccgagcggcagtgcacgcagcctacgcccaaatacaaaggcagatactgtgtgggtgagcgcaagcgcttccgcctctgcaacctgcaggcctgccctgctggccgcccctccttccgccacgtccagtgcagccactttgacgctatgctctacaagggccagctgcacacatgggtgcccgtggtcaatgacgtgaacccctgcgagctgcactgccggcccgcgaatgagtactttgccgagaagctgcgggacgccgtggtcgatggcaccccctgctaccaggtccgagccagccgggacctctgcatcaacggcatctgtaagaacgtgggctgtgacttcgagattgactccggtgctatggaggaccgctgtggtgtgtgccacggcaacggctccacctgccacaccgtgagcgggaccttcgaggaggccgagggcctggggtatgtggatgtggggctgatcccagcgggcgcacgcgagatccgcatccaagaggttgccgaggctgccaacttcctggcactgcggagcgaggacccggagaagtacttcctcaatggtggctggaccatccagtggaacggggactaccaggtggcagggaccaccttcacatacgcacgcaggggcaactgggagaacctcacgtccccgggtcccaccaaggagcctgtctggatccagctgctgttccaggagagcaaccctggggtgcactacgagtacaccatccacagggaggcaggtggccacgacgaggtcccgccgcccgtgttctcctggcattatgggccctggaccaagtgcacagtcacctgcggcagaggtgtgcagaggcagaatgtgtactgcttggagcggcaggcagggcccgtggacgaggagcactgtgaccccctgggccggcctgatgaccaacagaggaagtgcagcgagcagccctgccctgccaggtggtgggcaggtgagtggcagctgtgctccagctcctgcgggcctgggggcctctcccgccgggccgtgctctgcatccgcagcgtggggctggatgagcagagcgccctggagccacccgcctgtgaacaccttccccggccccctactgaaaccccttgcaaccgccatgtaccctgtccggccacctgggctgtggggaactggtctcagtgctcagtgacatgtggggagggcactcagcgccgaaatgtcctctgcaccaatgacaccggtgtcccctgtgacgaggcccagcagccagccagcgaagtcacctgctctctgccactctgtcggtggcccctgggcacactgggccctgaaggctcaggcagcggctcctccagccacgagctcttcaacgaggctgacttcatcccgcaccacctggccccacgcccttcacccgcctcatcacccaagccaggcaccatgggcaacgccattgaggaggaggctccagagctggacctgccggggcccgtgtttgtggacgacttctactacgactacaatttcatcaatttccacgaggatctgtcctacgggccctctgaggagcccgatctagacctggcggggacaggggaccggacacccccaccacacagccatcctgctgcgccctccacgggtagccccgtgcctgccacagagcctcctgcagccaaggaggagggggtactgggaccttggtccccgagcccttggcctagccaggccggccgctccccacccccaccctcagagcagacccctgggaaccctttgatcaatttcctgcctgaggaagacacccccataggggccccagatcttgggctccccagcctgtcctggcccagggtttccactgatggcctgcagacacctgccacccctgagagccaaaatgatttcccagttggcaaggacagccagagccagctgccccctccatggcgggacaggaccaatgaggttttcaaggatgatgaggaacccaagggccgaggagcaccccacctgcccccgagacccagctccacgctgccccctttgtcccctgttggcagcacccactcctctcctagtcctgacgtggcggagctgtggacaggaggcacagtggcctgggagccagctctggagggtggcctggggcctgtggacagtgaactgtggcccactgttggggtggcttctctccttcctcctcccatagcccctctgccagagatgaaggtcagggacagttccctggagccggggactccctccttcccaaccccaggaccaggctcatgggacctgcagactgtggcagtgtgggggaccttcctccccacaaccctgactggcctcgggcacatgcctgagcctgccctgaacccaggacccaagggtcagcctgagtccctcagccctgaggtgcccctgagctctaggctgctgtccacaccagcttgggacagccccgccaacagccacagagtccctgagacccagccgctggctcccagcctggctgaagcggggccccccgcggacccgttggttgtcaggaacgccggctggcaagcgggaaactggagcgagtgctctaccacctgtggcctgggtgcggtctggaggccggtgcgctgtagctccggccgggatgaggactgcgcccccgctggccggccccagcctgcccgccgctgccacctgcggccctgtgccacctggcactcaggcaactggagtaagtgctcccgcagctgcggcggaggttcctcagtgcgggacgtgcagtgtgtggacacacgggacctccggccactgcggcccttccattgtcagcccgggcctgccaagccgcctgcgcaccggccctgcggggcccagccctgcctcagctggtacacatcttcctggagggagtgctccgaggcctgtggcggtggtgagcagcagcgtctagtgacctgcccggagccaggcctctgcgaggaggcgctgagacccaacaccacccggccctgcaacacccacccctgcacgcagtgggtggtggggccctggggccagtgctcaggcccctgtggtggtggtgtccagcggcgcctggtcaagtgtgtcaacacccagacagggctgcccgaggaagacagtgaccagtgtggccacgaggcctggcctgagagctcccggccgtgtggcaccgaggattgtgagcccgtcgagcctccccgctgtgagcgggaccgcctgtccttcgggttctgcgagacgctgcgcctactgggccgctgccagctgcccaccatccgcacccagtgctgccgctcgtgctctccgcccagccacggcgccccctcccgaggccatcagcgggttgcccgccgctgactgcgccaggatgcacagaccgaccgacagacctcagtgcccaccacgggctgtggcggagctcccgccccctgcgccctaatggtgctaaccccctctcactacccagcagcaggctggggacctcctccccctcaaaaaaggtatttttttattctaacagtttgtgtaacatttattatgattttacataaatgagcatctaccattccaaagcaaaaaaaaaaaaaaaaaaaaaaaaaaaaaaaaaaaaaaaaaaaaaaaa

SEQ ID NO: 376 - DNA, 60 bp, Homo sapiens
cccctcaccacactgacttatttccctaaactatttataaaaagtagggcaatttcatta

SEQ ID NO: 377 - DNA, 1449 bp, Homo sapiens
ctggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaacc

SEQ ID NO: 378 - DNA, 60 bp, Homo sapiens
gaaggaaacaccgagtctctgtataatctatttacataaaatgggtgatatgcgaacagc

SEQ ID NO: 379 - DNA, 4661 bp, Homo sapiens
tttttgaatctgcggaggcggcggcggtggcagcggcggcgcggcgactgaagcgcgcgaaaagctgaggcggcaacgtcggggacggctgcgcgggacggctctgtaggaaggaacttggttccccctccctcagcttccgccccaaaagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacaaacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccata

SEQ ID NO: 380 - DNA, 60 bp, Homo sapiens
acatctctgagagaagtgaccttgctagcataaaacaccatctaatttcttcaaagaaaa

SEQ ID NO: 381 - DNA, 2096 bp, Homo sapiens
ctcctctgctcctcgaagaaggccagggcggggctgccgcaagttttgacattttcgcagcggagacgcgcgcgggcactctcgggccgacggctgcggcggcggccgaccctccagagccccttagtcgcgccccggccctcccgctgcccggagtccggcggccacgaggcccagccgcgtcctcccgcgcttgctcgcccggcggccgcagccatgtcccgggggcccgaggaggtgaaccggctcacggagagcacctaccggaatgttatggaacagttcaatcctgggctgcgaaatttaataaacctggggaaaaattatgagaaagctgtaaacgctatgatcctggcaggaaaagcctactacgatggagtggccaagatcggtgagattgccactgggtcccccgtgtcaactgaactgggacatgtcctcatagagatttcaagtacccacaagaaactcaacgagagtcttgatgaaaattttaaaaaattccacaaagagattatccatgagctggagaagaagatagaacttgacgtgaaatatatgaacgcaactctaaaaagataccaaacagaacacaagaataaattagagtctttggagaaatcccaagctgagttgaagaagatcagaaggaaaagccaaggaagccgaaacgcactcaaatatgaacacaaagaaattgagtatgtggagaccgttacttctcgtcagagtgaaatccagaaattcattgcagatggttgcaaagaggctctgcttgaagagaagaggcgcttctgctttctggttgataagcactgtggctttgcaaaccacatacattattatcacttacagtctgcagaactactgaattccaagctgcctcggtggcaggagacctgtgttgatgccatcaaagtgccagagaaaatcatgaatatgatcgaagaaataaagaccccagcctctacccccgtgtctggaactcctcaggcttcacccatgatcgagagaagcaatgtggttaggaaagattacgacaccctttctaaatgctcaccaaagatgccccccgctccttcaggcagagcatataccagtcccttgatcgatatgtttaataacccagccacggctgccccgaattcacaaagggtaaataattcaacaggtacttccgaagatcccagtttacagcgatcagtttcggttgcaacgggactgaacatgatgaagaagcagaaagtgaagaccatcttcccgcacactgcgggctccaacaagaccttactcagctttgcacagggagatgtcatcacgctgctcatccccgaggagaaggatggctggctctatggagaacacgacgtgtccaaggcgaggggttggttcccgtcgtcgtacacgaagttgctggaagaaaatgagacagaagcagtgaccgtgcccacgccaagccccacaccagtgagaagcatcagcaccgtgaacttgtctgagaatagcagtgttgtcatccccccacccgactacttggaatgcttgtccatgggggcagctgccgacaggagagcagattcggccaggacgacatccacctttaaggccccagcgtccaagcccgagaccgcggctcctaacgatgccaacgggactgcaaagccgccttttctcagcggagaaaacccctttgccactgtgaaactccgcccgactgtgacgaatgatcgctcggcacccatcattcgatgagaggacagccaaggactctcccgggcctctccggttctcccttgcggaatgatgggcgcatcctgtctgccacgtgctgacggtcgggaagcttcagtggagaggcctaactctaatgtcgcctgcttaagcaaatcatgcttctctgtttcacgtagttgggttgacaagtttctgcctttaagataaatgagtaatagtctaatgaccagctcagccatttaaaatattttcttcctattctgttcaagaaacagtaaacttggtttcaatctttaaaaaaaaaaaaaaaaaaaaaaaaaaaaaaaaaaaaaaaaaaaaaaaaaaaaaaaaaaaaaaaaaaa

SEQ ID NO: 382 - DNA, 60 bp, Homo sapiens
ttcacgtagttgggttgacaagtttctgcctttaagataaatgagtaatagtctaatgac

SEQ ID NO: 383 - DNA, 1542 bp, Homo sapiens; identical to SEQ ID NO: 13

SEQ ID NO: 384 - DNA, 60 bp, Homo sapiens
aatagatcttaaacataggaaaaccatactgttctgataataaaatgctttctatgaaat

SEQ ID NO: 385 - DNA, 2280 bp, Homo sapiens
gagggcgcttccggcacagcggaactccgggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagattcttctttactgccaaccaggtaaagatttacaccaatcaagagaaaaccaggacctttattgggcttgaggtcacttcagggcatgcccagttcctggacctggtttcagaggtggacagagtcatggaggaattcaacctcaccactttctaccaggatccttctttccacctcagcctggcctggtgtgtgggtgatgcacgtctccagctggaggggcagtgcctgcaggaactacaggcaatcgtggatgggtttgaagatgctgaggtgctgctgcgcgtgcacactgagcaagtccgctgcaagtctgggaacaagttcttctcgatgcctttgaagtgagcaccagaggccttcctcctccagggccctctgcagaccaggctgagatggaggaacctgctaaaatcgatggagatgcttctagcctcccagtaggaggccccagccatgccttcaacctggcaggaggtgtagccactcctcatcctccctgagtgctgatattctctctctctctttctcttcctcttctttctctctcttctcctctctttctctcctctgtctctcttcctctcctctcttcctctcttctctcttcctctcctctctctcttcctcttctctctcttcccctcctgtctctcctcccctcctctcttcctctcctctctcttcctctcctctctctacccctcctgtctctcctcccctcctctctcttcctctcctctctctcttcctctcctctctcttcccttcctgtctctcttcccctcctctctctcttcctgtcctctatctcttcccctcctctatctcttcctctcctctctctcttcctctcctctctctctcttgctttcttctctctctcctgtctcggctgttgtgggttgcaggttgggtgctgctgttgtggtccttcccagaaactgccagtagagggcagcctgggcatcctaatgcttactctggttgttacacaaagaaaatattggggtcactggcgagcccacccacactcaccagaatctccactgtagtccccctaacaaacagcccttcacttcctctcccacttcagcaatttgtattttgatgccattggcctcagatcagagtgttttaaatcatcacgccctggcttatccctggtcgagccaggacacggggtgcttcagtgggtctgtcaccctctctccttgaagcatgttgcttttatttatttacttttactctcaccctgctcctgtaccagcaggggccacttcaaagccaaggtacagggtgataacttgtggtccagcatcagttttctccacttctttctcccactcacccccagcaaggtgcctggggagacttgagcagatgtttcattttggcctggccagtggctgaaagccaggcctccaatgcactgtgacctctggcttccccagcagctttcccagagaggcagaggggccttccacagcccgggttctcctgctgcctcctgcctgctgcagctgcaggcattctgaggggcaacgtggaggaagggccagggatgcatgggattttaattgtttcatcacaccttccccgtggcaaagaaacagtcagtcctcttcaggtgtcttctggatttctggtgatggacagagaaatctttttacagtttcaaattatgttcaacaaataaaaattgcattttttattttggaaaaaaaaaaaaaaaaaaaaaaaaaaa

SEQ ID NO: 386 - DNA, 60 bp, Homo sapiens
gtgtcttctggatttctggtgatggacagagaaatctttttacagtttcaaattatgttc

SEQ ID NO: 387 - DNA, 1561 bp, Homo sapiens
gcccgtacacaccgtgtgctgggacaccccacagtcagccgcatggctcccctgtgccccagcccctggctccctctgttgatcccggcccctgctccaggcctcactgtgcaactgctgctgtcactgctgcttctggtgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagttgacgaggccttggggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagctccacaccctctctgacaccctgtggggacctggtgactctcggctacagctgaacttccgagcgacgcagcctttgaatgggcgagtgattgaggcctccttccctgctggagtggacagcagtcctcgggctgctgagccagtccagctgaattcctgcctggctgctggtgacatcctagccctggtttttggcctcctttttgctgtcaccagcgtcgcgttccttgtgcagatgagaaggcagcacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataataaaaaaaaa

SEQ ID NO: 388 - DNA, 60 bp, Homo sapiens
tcctgtcctgctcattatgccacttccttttaactgccaagaaattttttaaaataaata

SEQ ID NO: 389 - DNA, 1697 bp, Homo sapiens
gaggcgtaagccaggcgtgttaaagccggtcggaactgctccggagggcacgggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaaaaaaaaaaaaaaaaaaaaaaaa

SEQ ID NO: 390 - DNA, 60 bp, Homo sapiens
ttacaaggagctcatctcaggccatggctttgcacagaaccagctagttatttggaagta

SEQ ID NO: 391 - DNA, 6017 bp, Homo sapiens
gggcggggctcgggccggtccgcccgcgcgcaggtgagtgagccagggcggagcgcagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcaataaaatctacgtggttgacttgagtaatgagcgagccatgtcactcaccatcgagccacggcccgtcaaacagagccgcaagtttgtccctggctgtttcgtgtgtctagaatctcggacctgcagtagcaacctcaccctgacatctggctccaaacacaaaatctccttcctttgtgatgatctgacacgtctgtggatgaatgtggaaaaaaccataagctgcacagaccaccggtactgccaaaggaaatcctactcactccaggtgcccagtgacatcctccacctgcctgtggagctgcatgacttctcctggaagctgctggtgcccaaggacaggctcagcctggtgctggtgccagcccagaagctgcagcagcatacacacgagaagccctgcaacaccagcttcagctacctcgtggccagtgccatacccagccaggacctgtacttcggctccttctgcccgggaggctctatcaagcagatccaggtgaagcagaacatctcggtgacccttcgcacctttgcccccagcttccaacaagaggcctccaggcagggtctgacggtgtcctttataccttatttcaaagaggaaggcgttttcacggtgacccctgacacaaaaagcaaggtctacctgaggacccccaactgggaccggggcctgccatccctcacctctgtgtcctggaacatcagcgtgcccagagaccaggtggcctgcctgactttctttaaggagcggagcggcgtggtctgccagacagggcgcgcattcatgatcatccaggagcagcggacccgggctgaggagatcttcagcctggacgaggatgtgctccccaagccaagcttccaccatcacagcttctgggtcaacatctctaactgcagccccacgagcggcaagcagctagacctgctcttctcggtgacacttaccccaaggactgtggacttgactgtcatcctcatcgcagcggtgggaggtggagtcttactgctgtctgccctcgggctcatcatttgctgtgtgaaaaagaagaaaaagaagacaaacaagggccccgctgtgggtatctacaatgacaacatcaatactgagatgccgaggcagccaaaaaagtttcagaaagggcgaaaggacaatgactcccatgtgtatgcagtcatcgaggacaccatggtatatgggcatctgctacaggattccagcggctccttcctgcagccagaggtggacacctaccggccgttccagggcaccatgggggtctgtcctccctccccacccaccatatgctccagggccccaactgcaaagttggccactgaggagccacctcctcgctcccctcctgagtctgagagtgaaccgtacaccttctcccatcccaacaatggggatgtaagcagcaaggacacagacattcccttactgaacactcaggagcccatggagccagcagaataacttgatccattccagacgctttgctgagtttcataaagcagggcactgagacacccgtccgtgttcctaaccagaaatcctaaagaagaggaattatacagaaggaacagcaggaggttttcctggacaccgccaacttcacattgctcagtggactcattctaagggcaagacattgaaaatgatgaattccaatctggatacagtcatgacagctcatgtgctcctcaacttaggctgtgcggttagccagcctgtaatgagaggagagaggcctgagtcacctagcatagggttgcagcaagccctggattcagagtgttaaacagaggcttgccctcttcaggacaacagttccaattccaaggagcctacctgaggtccctactctcactggggtccccaggatgaaaacgacaatgtgcctttttattattatttatttggtggtcctgtgttatttaagagatcaaatgtataaccacctagctcttttcacctgacttagtaataactcatactaactggtttggatgcctgggttgtgacttctactgaccgctagataaacgtgtgcctgtcccccaggtggtgggaataatttacaatctgtccaaccagaaaagaatgtgtgtgtttgagcagcattgacacatatctgctttgataagagacttcctgattctctaggtcggttcgtggttatcccattgtggaaattcatcttgaatcccattgtcctatagtcctagcaataagagaaatttcctcaagtttccatgtgcggttctcctagctgcagcaatactttgacatttaaagagaaatttagagaatattctcatcctctaaaaatgtttaaatatataccaaacagtggccccctgcattagttttctgttgccactgcaacctattacttggtagcttaaaaacaacacattagcttatagtcctggggatcagaattccaaaatggatgtccctgaatgaaaatcaaggtgtcagcagagctgtgctccttctgaaggctctagggagaagccggttccttgccatttcaagcttctagaggctggctgcattcccaggctccagtggctggtcaagcttttctcacatggcatcactgtgacactggccctcccacttccctctttgacttacaaagcccaccaggaagatccaggataatctctccatctaaagttccttcatcatcctggaagagccttttgccatgcaagacaacatagccacaggtggggattaggaccagaacatctttggggtgctgttattctgcctaccacaccttcctgccactgactcccacaggagaggctacaaaatgatctggcgcacagggatgttttgtttagcttgcggactctaacacttaaaaaaaaacccagatcagaagatctggccatgctggggctcacattctcacctagcaacaactggctggagctgggcaccagctctgcctttagaaggggtgtccacttcaccaggtcaccacagcccacactacgccctatcacttcccacaatgaggctgagtgtttgtttctactgatcaatgcccctgcaggttgcatttattgtaatgaaaaagaaagactgggattaatctctaatcaggtgagtagaccatgagaccaatgtgtgctcacattaccctttttcttttttttctttttctttttctttttttttttaatgtgagacaggatctcattctgttgcctaggctggagtgcagtggcgcaatctcggctcactgcaacctctgcctcctgggctcaagcaattctcccacctcagcctcccaaatagctgggatcactggcacaaaccaccatgcccagctaattttgtattttttgtagagacagggtttcaccatgttgcccaggctggtctcaacctcctgggctcaagcaatcctcctgcctcggcctcccaaagtgctgggattacagatgtgagccaccgcatccagccccacaccctcatttataccaattacctgcccagtaactgtggacttttgcttcctcacccctgctctgatctggaaggagagggattatgttatagcttgtcagcacagtcccaagttcaatatttctgcggcaaaaacttccttcaaaaaataaatgtacttcattgtattcaatgaattcaccttggaaatgcaccgcctcaacttgttcacatggcataaatgaaaggaattttatagtctcctaaatggcgtgtactgcaagacctcttgaacactttccagaggataggatatttaagtcatgcccttggcgttgcctatggcacctttcccttctgaaagtctggttcctgcccagtgacccttggccttgtgagccgagatgctgaccctgcataaagggccaaaggagggctgcggcttccttccctcactgaagagcccttatttgaattcactgtgtggagccctagccctccattctcgacattccccaacctcccagccccttccaagcaggactaggtgccctgcattccacccaaggtgggattggccttccttaggctggctacttgtcaccatcaccgacatcactgttgcctgcaaggacaccacgtggccattttccttcaactgagggctcaaaactcctggacaagttgctggctcctgagaccagtatttcctggagctgtgcctcagtgaaggggcccagcctgaggaaccctggctcttttctttaaagcccaggccccacttacgtaaaacatttcagggtcactggaaacagtgaagtgccatttgttgaagcctactgcatgccagcccactgctcatccacgtggtctgccatgcctacgaggaaggccagcgcatgcaggactggtctctaatgctgtggtcattgcacagaagggaaaggtctcaaggaagagtcaactggaacaagcacaagcccaccggacatggccttggtaaaggttagcagactggtgtgtgtggatctgcagtgcttcactggaaataatttattcattgcagatactttttaggtggcattttattcatttcctgtgctttaaataaacaaatgtaccaaaaaacaagtatcaagctgtttaagtgcttcggctacttgtcccctggttcagtagaggccccggtttcccagttgttgactgtgacaggctcagcatgggctcagcagatgctgtcttaatttgtggatgatacagaaagccaggctttgggatacaagttctttcctcttcatttgatgccgtgcactgtgtgaagcagatgtttttgtccggaaataaaaataatagtcttggagtctcgccaaaaaaaaaaa

SEQ ID NO: 392 - DNA, 60 bp, Homo sapiens
tgatgccgtgcactgtgtgaagcagatgtttttgtccggaaataaaaataatagtcttgg

SEQ ID NO: 393 - DNA, 3217 bp, Homo sapiens
tccctcgcccggaggcagagatgcgctggcgcatcaccgccaggagcccacagtgaaagaccatcggatggaaggcgacgcccagaactccaggagaccgctgtgggaggacgcgaggccaggtgacgaataggccaggcgtgagttcccaaacagcctcctccccttcaagagagtaagcttgggccacaggctgggacggaagcagaggggcagacacgccaccacccgcccggcctcgaacctacggcggcacagttcagcggaggcggcccagcggtcctgtcccgcgcctgcgcactccaggccccgccccgccccgcgccctccaggcccggcccgccctccaacctctgcgtgcgcacagcctagagcccgcctccgtgaaagactgccgggcgcatgcggtcggggttgttcactggctgtccggggctccgcgcgcgtcgccggcccagctctgtcgctgacgggaggatctgaagccggccgcaggtcaaagagtaaaatgaagtacattctggttactggtggtgttatatcaggaattggaaaaggaatcattgccagcagtgtgggcacaatactcaagtcatgtggtttacatgtaacttcaatcaaaattgacccctacattaacattgatgcaggaacattctctccttatgagcatggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaagttgtccctcatatcacagatgcaatccaggagtgggtgatgagacaggcgttaatacctgtagatgaagatggcctggaacctcaagtgtgtgttattgagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtgggcaaatacacgaagttctcagactcctatgcctctgtcattaaggctctggagcattctgcactggccatcaaccacaaattggaaatcaagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttttttgggcgtgtgcttagggatgcagttggcagtggttgaattctcaagaaacgtgctgggatggcaagatgccaattctacagagtttgaccctacgaccagtcatcccgtggtcgtagacatgccagaacacaacccagggcagatgggcggaaccatgaggctgggcaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaagaaaaaaaaaaaaaaaaaaa

SEQ ID NO: 394 - DNA, 60 bp, Homo sapiens
agttactttcttaatgtgacctagcaataggcatagctacgtggcactatattctggcca

SEQ ID NO: 395 - DNA, 1812 bp, Homo sapiens
tagctaggcaggaagtcggcgcgggcggcgcggacagtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtctagagtcatgtgagcctcgtgtcatctccggggtggccacaggctagatccccggtggttttgtgctcaaaataaaaagcctcagtgacccatgag

SEQ ID NO: 396 - DNA, 60 bp, Homo sapiens
ttgtgtaattggcccaagtcattgtttttctcgccttactttccaccaagtgtctagagt

SEQ ID NO: 397 - DNA, 1310 bp, Homo sapiens
aaattgagcccgcagcctcccgcttcgctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaacc

SEQ ID NO: 398 - DNA, 60 bp, Homo sapiens
ctcaacgaccactttgtcaagctcatttcctggtatgacaacgaatttggctacagcaac

SEQ ID NO: 399 - DNA, 1492 bp, Homo sapiens
gtcactgggtgctgtgacatcagggcaattagcccaggacccacagccctggcgctccgcacgcacctcggtaacatcacagcaggtccaggccaatgataaccttataagaggccatgtcgaagcgcgacatcgtcctcaccaatgtcaccgttgtccagttgctgcgacagccgtgcccggtgaccagagcaccgcccccacctgagcctaaggctgaagtagagccccagccacaaccagagcccacaccagtcagggaggaaataaagccaccaccgccaccactgcctcctcaccccgctactcctcctcctaagatggtgtctgtggcccgggagctgactgtgggcatcaatggatttggacgcatcggtcgcctggtcctgcgcgcctgcatggagaagggtgttaaggtggtggctgtgaatgatccattcattgacccggaatacatggtgtacatgtttaagtatgactccacccacggccgatacaagggaagtgtggaattcaggaatggacaactggtcgtggacaaccatgagatctctgtctaccagtgcaaagagcccaaacagatcccctggagggctgtcgggagcccctacgtggtggagtccacaggcgtgtacctctccatacaggcagcttcggaccacatctctgcaggtgctcaacgtgtggtcatctccgcgccctcaccggatgcaccaatgttcgtcatgggtgtcaatgaaaatgactataaccctggctccatgaacattgtgagcaacgcgtcctgcaccaccaactgtttggctcccctcgccaaagtcatccacgagcgatttgggatcgtggaagggttgatgaccacagtccattcctacacggccacccagaagacagtggacgggccatcaaggaaggcctggcgagatgggcggggtgcccaccagaacatcatcccagcctccactggggctgcgaaagctgtgaccaaagtcatcccagagctcaaagggaagctgacagggatggcgttccgggtaccaaccccggatgtgtctgtcgtggacctgacctgccgcctcgcccagcctgccccctactcagccatcaaggaggctgtaaaagcagcagccaaggggcccatggctggcatccttgcctacaccgaggatgaggtcgtctctacggacttcctcggtgatacccactcgtccatcttcgatgctaaggccggcattgcgctcaatgacaatttcgtgaagctcatttcatggtacgacaacgaatatggctacagtcaccgggtggtcgacctcctccgctacatgttcagccgagacaagtgaaacgggaaggtcctttctttccttcccaggggccggggccggaacatgtgcctcccgttccagcatctggctgcccgggggaggaaggacacccggggcgggcgccccacgccgatgggtccatggtgaaataaaaaacagtgctcacg

SEQ ID NO: 400 - DNA, 60 bp, Homo sapiens
cgctcaatgacaatttcgtgaagctcatttcatggtacgacaacgaatatggctacagtc

SEQ ID NO: 401 - DNA, 4878 bp, Homo sapiens
gcggccgcggccagggcggcccgtgggaccgcgggcccccggcgcagcgctgcccggctcccggccctgccggcctcctcccttggcgccgcggccatggcggccagcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagctcagaattctgcaaatgcagattttgcaaactttgatgcatttggacagtctagtggttcgagtaattttggaggtttccccacagcaagtcactctccttttcagccccaaactacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaacctttggcactgcatccatgagcatgcccacaggattcggcactcctgctccctacagtcttcccaccagctttagtggcagctttcagcagcctgcctttccagcccaagcagctttccctcaacagacagctttttctcaacagcccaatggtgcaggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaatatgctattgtttttgtgttcttgctgcaatgcctttaccaaagtggccttaaatatgagtagtgaattgagaacatcttgaattcttaaaagacttcttagtgactttttataaaaaggccatgtagaaaatttattaaaactactatgactgctacattcaggaatatgccagtggtaaagcatttaaatgtagcttgtcagatttaccataatcctactaatttctttgcagcttattaattttgtgaaatttgtatatatgaagaatttgcatgtatgtgtatttacaaatttttctaagtatcttgaattctcagactgcaaaaggcctattttaactattgattttttttaaaaaaaattgtctttgaatgtattggaagtagacatgcattaactgtgacattattgcacctcagtttttttctttctttttttgggcaaactgatattatctataggatatttgtttatgtttgttttttgggggaaagaaactggaactcagtgttaccttaaagttacggaatactttgttttaaaggaaaagataataagtttagttatatctttttgttaatattcaaatgaacttgtttaagtatctatgtacagtaatgcctcattcatctagaggtaatctggcagtcttgtgaaaaccgaacacaactcagaaacttggaatcgttttttttaaaaatgcctctgagcaacccatataagtcacaaagtctgtgtgttagagcttatgcatttgtttttatgagagattttaataaatttaattatttgcttgtccagactatagcatattagctgtttagaagggatggcttgaaaggaaggagactgaaaaacactctgagagcatacactgtccaaggccattagtgtaaggaccgctacccagcctagaggacatcactatactacatcatctgatgattattctttattatgcctctaggtaattaagtaaaggtgaaattgcatacacagatatgtagtacatattttaaaagttttatcttaaattgattaaaactttttaaaaagctttggtattaaaagaggtaaacatcagtttcctcaaacattttattcatgttgaatgcctttttgcaatgatgactgagttgttatcatagtattttaaaacctgtatagtgttttagacttgttaaaacattgctgtctagtgtacatctagctaaaagtgtggtttatctaaaccgttttaataagcaagatgactgggaaatctctgccccttttctgagcagtatgcctcttcttttagaattaaatgaatgctgcacaggtccagatgtgtgttgatgtagacttgaaatgtctccacattttggaggacttcctcagcccttttcattgagggaaaatatatttgaatttctgttttagattgtatcgggtcccagttgattcatgtgtacaaagttatgctacctaattacagaccattacccaaatatcctaccaggctttccatctgaatagtaaattaaacagttgttatcaaaatgattttaaagactatttctttttctgggtaactattgaagtttgtaattaaatgggggctcttactgactttaaattagcgcttataaaataaaaatgtttagttcaagaagagacccaagctgggtatggtggtgtgagagcctgtgagtcctagctacctggaggtgaggtgggaacatcacttgagcccaggagttggaggctgcagtgcgctacgatcacaccactgcacaccagcctggggatagagtgagatcccatctctaaaaaatgaaaaaaagaagagaggtagctttaaagtggtttttctcatgatattcactgtttattattaaagaaaatcagctttcgttagacttttacatttagatttattctagttttatatagaccatcaaaattatgttgagtactaaaaaggagaaaaaatcctggaaggtaacaaggctgaagaccttcaaatttcctggcttactggtttagtcacatcatttttcctgttcaggtatctgcagatatccctgttcaggaaagatcttttttcaggatggcaaacttttgacatagtttaaagacattttttccccattttttgaaatagagaatattttattatttttgtgaaaatagagttttggtaatcactttcttcctcaaaataagtccttctgttaatttgtaaaagcacattagtgctttacctgtgaaattccccgcccccctgcacacacacccactttagtacagttcctgtcaattggcaacatggagagggtgacctggctgctggtttaccactgtaccaacatctctggagcattttagtttcagaaccttaacactccccaacagctttgttgatgtagcttgtatctctgagaatttattgtattaaaattaatactgagatatttttaaaa

SEQ ID NO: 402 - DNA, 60 bp, Homo sapiens
aaggtgctgtcatatatcttggaatgaatgacctaaaatcattttaaccattgctactgg

SEQ ID NO: 403 - DNA, 7555 bp, Homo sapiens
ggggaggggaggagcgggatttgcggagcgccgcgccgctgccgggagccggcaggcccgagagtgaccggagtcacggcgggcgccggcggagctgcggcgtcggacccgcctcctggaggagctcagccccgaccaggcccggccccattcccgccccgcgccgcctccccgccgccgccgccgccgccgccgcgggagcgctcccctgcccaccccgcccccgcggccgagcccgggagtcgagtgggagtcggccggccggcgcgggcagcgccgggaccccgcgggggacactgcagccggagcccgggaggggccgcgccgccaccgtctgaactaggatgtcccgacatgaaggtgtcagctgtgatgcatgtttaaaaggaaattttcgaggtcgcagatataagtgtttaatttgctacgattacgatctttgtgcatcttgttatgaaagtggtgcaacaacaacaaggcatacaactgaccacccaatgcagtgcatattaacaagggtagattttgatttatactatggtggggaagctttctctgtagagcagccacagtcttttacttgtccctattgtggaaaaatgggctatacggagacatctcttcaagaacatgttacttctgaacatgcagaaacatcaacagaagtgatttgtccaatatgtgcagcgttacctggaggcgatcctaatcatgtcacggatgactttgcagctcatcttacacttgaacacagagcccctagagatttagatgaatcgagtggtgttcgacatgtacgtagaatgtttcaccctggccggggattaggaggtcctcgtgctcgtagatcaaacatgcactttactagcagttctactggtggactttcttcttctcagagttcatattctccaagcaatagggaagccatggatcctatagctgagcttttatctcagttatcaggagtgagacgttctgcaggaggacagcttaattcctctggcccttccgcttctcagttacaacaactgcagatgcagctgcagctagaacggcagcatgcccaggcagcacggcaacaactggagaccgcacgcaacgcaacccggcgtactaacacaagcagtgtcaccactacaatcacacaatccacagcaacaaccaacatagctaatacagaaagcagtcagcagactctacagaattcccagtttcttttaacaaggttgaatgatcctaaaatgtctgaaacggagcgccagtccatggaaagcgagcgtgcagaccgcagcctgtttgtccaagagctccttctgtccactttagtgcgtgaagagagctcatcctcagatgaggatgatcggggggagatggcagattttggtgctatgggctgtgtagatattatgcctttagatgttgctttagaaaacctaaatttaaaagagagtaataaaggaaatgagcctccaccacctcctctttgatgacatcccaattcgcagacaatgtcctctgtgctgtatttgccaatgaaagtggacaacaactatcttgggtttgtttggtgattgtaatttcaggtctgtcactcttgttacattgtgtacattcaaaaggaagagagaaaatatatatgataatcatttccacttaactaatttttacttctagcaggtaaatgtaggtagcagtgcaggggtgatctctgcttcctgtaccttgacatgcaaaaggctctcctaatactccacattcaaactgaagaggaaaattgaaatctctaatgaagctgctgtgtgtatttatgaatattaatgaataaaaactgcttggatggtttaccttaactactgcatgaggttttttgcagcgtgcatgagttttagtgaccttgttatttaagaagttaaatacaaggagtaaaacttaaaaaaaaaatacaaagcccaaagctttcccaaacattattcaatggttacacgacgaagtagcttttgaataatgtctgcctgaatcacctttctttgtgtgcctcctacgcacaaagccagctctgcagtggaatctggggattatagccgggtgtggcactccgccctgtgtgactgtcctgtcgccctgttagtcatcttgcctgtgtggagctcagcctgtctctttaactcatctgtagaagacacaccagtaaagctactgttggaatctgctgcaggggcctttgtgtgccctaaaaacaaatcctgttcatgtttgtttaaagtttttactttttgtggttgtttaaaattttttcaattgttaaatatgttttattcaggtgtagatgaatttcatttattgactgttcaacagagttaacctgaattatgttgtctttgtttttaaaaatctcacattctcaatcatattttgcattatttatgtatttgctttgtagtttgctgagacagatcagtatcaggggagctttgaggatttgccttcccagatttgtcagtatattacaaccaaattcttaatgctaattttagcaccttttatttattgggttttttctggcataaaaagtaaagccttttaattgaatcatgccacctatatgcctatattattaatcctatgtgtaaaaaaaatgtacagctttttttgggtttgttttggggtttggaagggccgggttattttttatttcctgtttcagtttttgtgcatagactttcacaatagctccaaggcagggacagcgggtttgggggttgggagggcagtttttggaatgtaaatttaggacttttaaaaaggtgcgcacagcttctgataaatttataactagacttaacctaatcatgtctcgttccagttctcttttctctgagcccttttcaaagtctcctctctttctcctgtcatccttttcctttcctgtccgtgtatctccgtttcttcaacatgacaagcatacagacttgaacacccctccggtgttcttccgagaactgtgaagtccatgttcatccaaatgtaaccaaaaaagaagtcaccctacatgtctgaaaaactgttgcttctcctctgaaacttcaaactccaacgatttccaaatacaatagctttgttttctttagttctgtaatggataatgtttaaaggaaaactttacaccaggcttctggttacactagaagtcaagcccattagggattttcattttttttcatttggttgttgagaagtttcaaaaatcagttttcaagctgtggtctttcaaacacatctgcacataagtcacacatttcaataaagcattttcaagactgttgaccacttgaatttctttggtgttagtggattaacctaaccattactctgagattttatatctctaatccagtattttttttctttttatgctaaacatgggagatcctggttttgtgtgaatgcattattttggatgtgagaaataaatgccaattatatgtactttcccttttctgcacaaattctgggaaaatgtaaaagccttcattttttaacatggttttagggaacaactgtaagtccattcagagcagtttaatttagatgatcacttttaacactgcagaagacctaaggagtcataagattccatctcatgtagaatactgtatattaattattttttaccagatattttacaaatacctcacctcatcctgtatgtaatcaataatgtattattttagggtagaacgacacagaatatcaatataaaaatatattcaagcccttgaaattcttgtgtcctttttctttagtttctgaatgaaaatcttattactggatgtactattgaataaaaattaattgcaaagactttgatggagacaaaatcaaaatataccactgtttattttggcagcaccttcaaatttctaaggaccagatcctgaattttgagaattttttgtttcgttgagttttgagtgtctaggatataagtttataaatgttctacagtgcttgtctttacttcctgtttagaaatcatttaaatctttcccctcgaggtgctctggaagaagtttaatttcagctctgaacaagtagaaataactgtgcttccttgtatggctgcaatcataagacagaatttctgtggttggctaccgtgaaatctttgtatttatattgcattgttttgttaaaaaaaaaaaaatccacagaagtagaacctaggtttgctactaacaaagtagtggattcttataattaggctcaggtaaagtaagagaaaacttctctccctgtggcccccagagaaatgaagtaggatagcagattacactattagaaataatagacgtaacaaaaaaaatccagcccattatccccaccccccattttccctctcaatattagaaatttcaataatatgctgacagattttcaaaggtcaccaaggcttttgtgtttttttccggtctgtgggccacagttaaaagaacgggtaacaggttcagagttctcttgatacgtccaagccttagtttccaggaaaaaagctaggctcctcactgcaaatattaacgctttatatatttactccatggatgttggggtaagcacatatatcaatagttcatagctctagttaaggacaaagtgggttggggggtagaaggagaatactagagaggttacggtagcaggtggctgcagaaaagaatcttttgaatgggattcctgtaacagtgttcagtaccaatattaagtctactgtaagtggggtctgatatggcttactgatacaggcatgtgtaaaaaactaagtgtgatggaggaatgggtgctaaaagctcttaacagttttgtagagaagccctgcagccgtgtttactatatatgacatgcctgtttcttagtttgcatgcacagtttaaggggcacatgcaatattggtttcatgtgcagtaaaaattaaaacacggctgagcgtggtggctcacgcctgtaatcccagcactttgcgaggccgaggcgggtggatcacgaggtcgagtttgagaccattttggccagcatagtgaaaccccatctctactaaaaaatacaaaaagttagctgggcatggtggcaggcacctgtaatcccagctactcgggaggctgaggcaggagaatcgcttgaacctgggaggcagaggttgcagtgagctgagatcacgccgccattgcactccagcccgggcgacggtgcaagactctgtctcaaaaaaaaaaaaaattaaaacactaggtacgaaattatcccagaattatacgcgaaagttggtgttcatgctggaaaacagttacggttatctgtgctctttctaaagctcaactagacactaaaacagttctctccttgagaccggaagtgggatgggggtgggcaggtggaagggaagaggctggggaggagcctctcatctcatctcatttcagcctcaacagtaattgaaaccctatgcctggcctggagtgggtagaggttagggttagagtgcaggatggagcagcagtctgcagactttcaggttgtgacgatgtcatgaaattctgtgctattaaacatggctatgtctgagtcagtcattacggtattccaaagccaaattcaagtgactgtttttctgaatagtataaaaatctaattccctgtgcttatcggcttcaactgtgcttacacaacgtttgtttctaattcgtactcttgcctcttggtttctgtagtttttcaacccatttctgtcagtgttctataaatgcatacattcgttatttaaggaaccctgcagcagacctcgaataaaatgtgacttgatgtttgttgccacttcctcaacttggttagcaaattcaagttttgaaagacgattcgtctcagagaagttgatcctgaacctccacgtcacattttagtcggttgctattaggtgggtaatgcctaataacatgggttcctcaaatcacaaaggagaatgctctcaagtcctcatgttaactttagtaagtcagttaactttacagcaactaaagagatcaattaaaaagaacccttaagtctgactgtcccaggtaactttacttgctgtacagatagtgcacagatatggatgagggctgcacatggctgatttgaaaacccatgtggggccgggtgtggtggctcacgcctgtaatcccagcactttgggaggccaaggcgggtggatcacgaggttagttcaggaccagcctggccaagatggtgaaaccccatctctactaaaaatacgaaaattagctgggcttggtggcagatgcctgtaattcctgctactcgggaggctgaggcagagaattgcttgaacccgggaggcggaggttgcagtgagccgagattgcgccactgcactccagcctgggcgacacagtgagactctcctcaaaacaaaaaaaaaagaaagaaaacccatgtgggccgcatgtgcacagcctggggctgctttccacaggcctggataatgatgtttctcttcaaggaggcctttactaaccacagggaacctagcatctgactgtgtccttggcagacagtgcatgtagcctgtagaatgttggctcctctgtctatagaaaccatcagttcgctgctctctcattcatacatactttttgagttcccagtaggtacgaagctttgtctaaacattatttaccaactgcgatttttacagacttcccctgtaagaattttctaaaagagcctttctcccttacacaattgaaacgttttcaaaggtcatcaagccggttgcgtttggtcagtcacgtgaccaatcagagctggtgagtgagctgctcccttaaatctaccaaattagactgacagcatttggaatctgcctcacacataagagatccatattcatttaatagtgaagccagcccagaagcatcctcttctgtaagctggatggagtcccagctctctctccttgtatataaggagaccacaccctgtatataaggttttcttgaggtagatgcagcaatattcctggggtaagattctataatactcctgtattggcaagtggactggaccaacagacacaggcctcagccactgtcgctagggactgaaggagagttcatggattcttaccccctagtcatgaaagctattctggccagccttgaatccatttaattttgcccacgagaacctttcatgacaattaacaagacactagtttccccataaaagtccatttttaaatatatagtatgctaattagcagtgtctgttgaattgccctatcggatagcagccaccatgtgtgctgaccactcacgattcagacttaccttggaaaatatcacactgacgatacagtactttagaataaattgcatattgtatcaggctccgagactaatttgtactgaacccttgatatagattaccttttataacatcaccacctgtcatgaagcttatctgttttctgatttgaataaactttgtgttgtgcaaa

SEQ ID NO: 404 - DNA, 60 bp, Homo sapiens
taatcatttccacttaactaatttttacttctagcaggtaaatgtaggtagcagtgcagg

SEQ ID NO: 405 - DNA, 1795 bp, Homo sapiens
agtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactac

SEQ ID NO: 406 - DNA, 60 bp, Homo sapiens; identical to SEQ ID NO: 89

SEQ ID NO: 407 - DNA, 2731 bp, Homo sapiens
ccacatgtaggcagttcagaggtgcttcccagggccctggcgctagtgcctgtccctcctgctgaagttgcctttcctggtgtccagtgattgaattctaaattcagcacatataccagaggaatacgagccaaagaagttgttccagctagagttgctgggaatccatgaatcaaagacttgctcagctagttctgtatgtgaaaggaaatgggtgtgactctgaggaagcctttttaattctgattcaggagatacataattagatgccacttgattttgttccacagactttttgctgaggacttgagagctaaggttctgtgatccagaactagttccagacttactcttctggaaatgaacagggccctcctgtgcttatttttccaggatactgcattggaaattgagtcagggacccattggtgagaagagaacagtgaacagaatcacattgatctggtcctggagtttgtctgacaatttctacttgaccgcaggaggtctgaagattggaaggggccctactcaattgtgctatttttctctcttttttttttttttgagacggagttgcccaggctggagtgcagcggcatggtctcagctcactgcaacctctgcctcccgggttcaagcagttctctgcctcagcctcccaagtagctgggattacaggtgcctgccaccattcctggctaatttttgtattttcagtagagacagggtttcaccatcttggcctggctgatcttgaactcctgacctcgtgatccaccggcctcagcctcccaaagtgctgggattacagacgtgagccaccgtgcccggccaatcctgctatttctctacaggacaaagggatatataatctgcaacatgccctccatgttggaacgcattagcaaaaatttggtcaaagagattggaagcaaagacctgacacctgtcaaatacctattgagtgccaccaaattacgtcagtttgttatattacgaaagaagaaggattctcgttcatcattttgggaacaatctgactatgttccagttgaattctccctcaatgacatcctggagccaagttcttcagtcctagaaactgttgtgacaggaccgttccacttcagtgacattatgatccagaagcataaggctgacatgggtgtgaatgttggtatagaagtgagtgtgtcaggggaggcctctgtggaccatggatgctccctcgagtttcaaattgttaccatcccatcaccaaacctggaagactttcaaaaaaggaaactgttggatccagagccatcatttctgaaggagtgccggaggagaggggacaacctgtacgtggtgacagaggctgttgaactgatcaacaatactgtgctgtacgatagcagtagtgtgaatattttagggaaaattgctctttggattacctatggcaagggtcaaggccaaggagagagtctcagagtgaagaagaaggcgctgactcttcagaaaggcatggtgatggcttataagagaaagcagctggttatcaaggagaaagccattctcatctcagatgatgatgaacagagaacctttcaagatgagtacgaaatttccgaaatggtaggctactgtgctgcgaggagtgaggggttgctaccatcatttcataccatctctccaaccctcttcaatgcctcatccaatgatatgaagttaaaaccagagctatttctgacacagcaatttttgagcgggcatttgccaaaatacgaacaagttcacatcctcccagtaggaagaatagaggaacccttctggcaaaatttcaagcatctacaagaggaggttttccagaaaataaagacactggctcagctctcaaaggatgttcaggatgtcatgttctacagtatcctggccatgctcagagacagaggggctctacaggacctgatgaacatgctggaattggacagctcaggtcatttggatggccctggtggtgccatcctaaagaaacttcaacaggattcaaaccatgcatggtttaacccaaaggaccccattctttatctccttgaagccataatggtgctgagtgacttccaacacgatttgctggcctgttccatggagaagaggatcctgcttcagcaacaggagctggtaaggagcatcctggagccaaacttcagatacccctggagcattcccttcaccctcaaacctgagctcctcgccccactccagagtgagggtttggccatcacctatggcctgctggaggagtgtggccttaggatggagctggataaccccaggtcaacctgggatgtagaagcaaagatgcccctgtctgccctctatgggactctctcgttgctgcagcagctggctgaggcctaagccctccctgatgggcagtcagtccagagatgctggccctcgcccagtctatgctgtgagtgtccttatgggtgcaagagatagggctgtgcctctctgcgtttccaggtggagtagagacagtaatgggtagagactttaggaaatgttttggggtggtggaatactctatatattgacaagagtttatatattgacaagagtttatatatttgtcaaaactcctcaaatagtatgttaaagacgtaagcgtttcactatgtataaattttacttcaaaataataaaaacaaatactgactctaaaaaaaaaaaaaaaaaa

SEQ ID NO: 408 - DNA, 60 bp, Homo sapiens
tatgggtgcaagagatagggctgtgcctctctgcgtttccaggtggagtagagacagtaa

SEQ ID NO: 409 - DNA, 3981 bp, Homo sapiens
cgacaggggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagacttcaaaaaaaaaaaa

SEQ ID NO: 410 - DNA, 60 bp, Homo sapiens
gcattgctgtgaattagctcacttggtgatatgtcctatattggctaaattgaaacctgg

SEQ ID NO: 411 - DNA, 3074 bp, Homo sapiens
aacaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcagcggaaaaaaaaaaaaaaaaaaaaaaaaaaaaaaaaaaaaaaaaaa

SEQ ID NO: 412 - DNA, 60 bp, Homo sapiens
gagtacggatgggaaactattgtgcacaagtctttccagaggagtttcttaatgagatat

SEQ ID NO: 413 - DNA, 2344 bp, Homo sapiens
ggcccgcccccgcgcggccgcccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaaaaaaaaaaaaaaaaaa

SEQ ID NO: 414 - DNA, 60 bp, Homo sapiens
agtacttgattggtcatttgaaaacactgcaacagtgaacttttgcatctcaagaaaaca

SEQ ID NO: 415 - DNA, 2487 bp, Homo sapiens
cctttcccctcccgccggacctgccaggaggtgggctggcgcggagggagggccctgtcccctgtccctttaaggaggagggccaaacgccggcctagagtgcggcgtagcccccacccgccgtgccctcaccccagagcagctgcagcctcagccggccgcccctccgccagccaagtccgccgctctgacccccggcagcaagtcgccaccatggtgaagatcgtgacagttaagacccaggcgtaccaggaccagaagccgggcacgagcgggctgcggaagcgggtgaaggtgttccagagcagcgccaactacgcggagaacttcatccagagtatcatctccaccgtggagccggcgcagcggcaggaggccacgctggtggtgggcggggacggccggttctacatgaaggaggccatccagctcatcgctcgcatcgctgccgccaacgggatcggtcgcttggttatcggacagaatggaatcctctccacccctgctgtatcctgcatcattagaaaaatcaaagccattggtgggatcattctgacagccagtcacaacccagggggccccaatggagattttggaatcaaattcaatatttctaatggaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacagtggaaattgtggattcggtagaagcttatgctacaatgctgagaagcatctttgatttcagtgcactgaaagaactactttctgggccaaaccgactgaagatccgtattgatgctatgcatggagttgtgggaccgtatgtaaagaagatcctctgtgaagaactcggtgcccctgcgaactcggcagttaactgcgttcctctggaggactttggaggccaccaccctgaccccaacctcacctatgcagctgacctggtggagaccatgaagtcaggagagcatgattttggggctgcctttgatggagatggggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagtatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctacaaaaaaaaaaaaaaaaa

SEQ ID NO: 416 - DNA, 60 bp, Homo sapiens
aacaaaatgtattcaccaagcattttaggatttgactttttcactaaccagttgacgagc

SEQ ID NO: 417 - DNA, 850 bp, Homo sapiens
ctgcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatataattgaaaaaa

SEQ ID NO: 418 - DNA, 60 bp, Homo sapiens
gctggagacactgtacagtttgcagaatatattcagaaaaacgtgcaactttataagatg

SEQ ID NO: 419 - DNA, 4549 bp, Homo sapiens
ccagggtgaaagttcagcgcgccggcggcacttccaacatggcggcggccggggcggcggtggcgcgcagcccgggaatcggagcgggacctgcgctgagagcccggcgctcgcccccgccgcgggccgcacggctgccgcggctgctagtgctgctagcggcggcggcggtggggccgggcgcgggcggtgcggcgcggctgtaccgcgcgggcgaggacgccgtgtgggtgctggacagcggcagcgtgcgcggggccaccgccaacagctcggccgcgtggctcgtgcagttctactcgtcgtggtgtggccactgcatcggctacgcgcccacttggcgggccctggctggggatgtgcgagactgggccagtgccattcgcgtcgcagctctggactgcatggaagagaagaaccaggccgtgtgccatgactacgacatccacttctaccccaccttccggtattttaaagcatttacaaaggagtttacaactggagaaaattttaaaggacctgaccgagagctgcgaacagtcagacagacgatgattgacttcctgcagaaccacacggaaggaagccggccccctgcctgcccgcgcctagaccccattcagcccagtgatgttctttcccttcttgacaaccgtggcagccattacgtggctattgtctttgaaagcaacagctcctaccttggacgggaggtgatcttagacctgatcccgtatgaaagcatcgtggtgacccgagcactggacggggacaaagcatttctggagaaacttggtgtttcttcagtcccttcgtgttacctgatctacccaaatgggtcgcatggattgattaacgtcgtgaagcctctgcgggccttcttttcgtcttatttgaagtcattgccggatgtgaggaaaaaatcgcttcccttgcctgaaaagccacacaaagaagaaaattcagaaatcgtggtttggagagaatttgacaagtcgaagctgtacacggtggacctggagtcagggctacactacctcctgcgggtggagctggcagcccacaagtccctggccggagcagagctgaagacgctcaaggactttgtgactgtcttggccaagctgttccctggacggccgccagtcaagaagctgttggagatgctgcaggagtggctggccagccttcccctggacaggatcccctacaacgccgtgcttgacctggtcaacaacaagatgcggatttctggaatattccttactaatcacataaagtgggttggatgtcaaggaagccgatctgagttgaggggttacccgtgttctctctggaaactgttccacactttgactgttgaagcctcgacccacccagatgcactggttggcacaggctttgaagacgacccccaggctgtgctgcagacaatgaggaggtacgttcacaccttctttgggtgtaaggaatgtggtgagcactttgaggaaatggctaaagaatccatggactcggtgaaaaccccagaccaagccatcctctggctgtggaagaagcataatatggtgaacggccgcctggcaggccatctgagtgaggatccccggtttccaaagcttcagtggcccactccggacctctgcccagcctgccatgaggaaattaagggcctggccagctgggatgaaggccacgtgctcacattcttgaagcagcactatggccgcgacaacctcttagacacgtattccgcagaccagggggattccagtgaaggaggaaccctggccaggggtgaggaagaggagaaaagactcactcccccagaggtgtcccatggagaccgagacacccagagcgtccgtccacctggtgcactgggccccaggcctgcccttccagagagcttgcatcacagcttggacgggaaactccagagtctggatgggcccggggcccacaaggaggtgggcggggccgcacccttcctcggggttgacttctccagcctggacatgagtctctgtgtcgtgctgtacgtggcttcatccctgttcctcatggtgatgtacttcttcttccgggtgaggtccaggcggtggaaggtcaagcaccaccacccggccgtgtgagtgcccgggtgctgccagccacggcggaagctcccttggaggcagccctgccccgtgccacctgcagctttaatatttatgatcagggattttataaacatgcgggcctggtttcacatcggatggcaccttttggcttcaaagtcctggttttacaaacgctcttctaacaagggaagaacacggggtaattttgtggggatatttgcattcctggcgtactcaagtctgttcatgctccttttgcaggtcttacagcaaaaagacttctgtatttttactcttctagatgtgaaaagagggtgcagagtccaggccagatagtcttccccacacactttcatctcgtttcctccactccgccccatcctgcagggccttgtttttgtatttggagaacctcgcccatcccccccgcggctcctggctcccccccactcccctcgctccccctccccccgctccccccacgccccctgctccaggctgccaagtgttttcctttagccgggcggggacagacagagccggaagcgcagtcggcctctgcagcccctccaagcaagtgctccagggactatcctgtgtttgtagctgcttccctagggcaggttcctgagggctctccttgttcctccgggtgttcgacaccagacgtggggatttcaacaggggaggagccaaggaattctgtggctgtgctgcgtttcagaaaataacccccagaggccttgggctgtggacctgggggttggaaggatgggggctcatttaaccctcagaggcagcgcctttgtctgtctatctggtgacaagagagagacaagtaaatgggggccgttgggacggcgggtgcctggagggcagctctgggctcagcgggcagtgcttagagcacaggcccctctgttgggggatggggaggagagcagtctgcccttgggagcgtaggccccagggagacttctaaagccccccctgtcgtctgctcttcacccagcaccacagaggcacctgctgcacacacaagcatctcactcggcccacggagggggccaggcttcctttgcctgaagctgttttgggaagggtctccacacaggcactgatctcccaagcttttgtcatgatgtcttttaccatttgataattttaaacattgtttttaaacccaaaacatttagtggtccgttgcctctgaagatgtaaacaaacaaatacactatttctgggaacatttatattgagattctttgtggctattggtgtgtctcacaggcaaaatttgatttggctaaaataggctcagatgtatttgtgtgcccgtgtgtgtgtgtgtgtgtgtgtgtgtgtgtgtgtgtgtatgagagagagagagactttgacggttgtagatattttttccgctttgcctactttatgttgtataatcatgtgtttactaacaagttgatgacatggatgtattcataagaccatgtaatattgatgtgattgttgtcgcttgagaaaaaaaggcaacagctgattctttcaacaactgtcacagaatggctgggctgagaacgctgcccagggccctgcagctggcgggagaggtgtctggtgggagcggtgtctggtgcgtcagcctgctgcttcgtgtctcactcgagagttgcttctggtttcacactttttaacccctctgtgctttagcagccgtgaccttgccttcattgcttcatccagtgcaggcctgggttattgaagacaccaaagtgtttctcttccagtttgaaaaccaggcaggtttacacgtgggtttcagtgtatttgcctttgaacccttcaaactaaactttagccttttggctggtgttgaatgtctttagctggggtgacctggagtgacctgggacggtgttgtggtttaccgtctccagcttcagcctttccagaaacccttgtggagggcagtgttggctgcaggtttcatcatattgcagtttgaggtcaccactatttggggaacaagcttgcgtcctgctgaggggcaggattttcagcagagcgtcggtggggctgggccgtcgtggaggtggccccaggagtcatatggccatactcagacacaccttgtgtggcctgctcagagctggatgccacctttaggcaatgtttagagtctattttctaaagttttaagtattttaagaggtattgagactaatgaatataatagttcagtaatttaaatgcttatttattttcagtggaaggatttttattaaaaagaagctaattgacatggaaatgtcagtgaaatttcttacctgcaaggaaagtgaacattttgtatttaagtaaactataatgtgcacattttaataaagaaatctgacatttgaaaaaaaaaaaaaaaaaaaaaaaaa

SEQ ID NO: 420 - DNA, 60 bp, Homo sapiens
ttgtatttaagtaaactataatgtgcacattttaataaagaaatctgacatttgaaaaaa

SEQ ID NO: 421 - DNA, 595 bp, Homo sapiens
gggcaaggctgggccgggaagggcgtgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacatgaaa

SEQ ID NO: 422 - DNA, 60 bp, Homo sapiens
gttataactacactctctccaagacagagttcctaagcttcatgaatacagaactagctg

SEQ ID NO: 423 - DNA, 2612 bp, Homo sapiens
cagcagccagggccgcctcttaaagggaggtggccggccttaaaggacccccgcgcgcccagccggcgggagcgcggcggcccggctcccgcagggccgcgccgaggcaggcgagcccccgcggcgcccaggcgcgggcccgggcccccgccgccgccgccgccgccgggcgcggcatttttattcaggcgacgcttaagggagcccggccgcgcccggtgcattgtgggagcggcccgcggcccgttttcgggaggaggcggagggcgcaaagcgagccggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacgtctgtaacaggcggccaaacagtactaaacccctggattgtcctgggaggagtggctaccactgtctgccaacccaatgaatttatcatgccagacaatgcagtgccaggggacgtgctggtgctgacaaaacccctggggacacaggtggcagtggctgtgcaccagtggctggatatccctgagaaatggaataagattaaactagtggtcacccaagaagatgtagagctggcctaccaggaggcgatgatgaacatggcgaggctcaacaggacagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaattttttaaaaaaaaaaaaaaa

SEQ ID NO: 424 - DNA, 60 bp, Homo sapiens
tcacttcaattaaagactataaacaacaaaaatctcattgtgtctacacatcggggtgac

SEQ ID NO: 425 - DNA, 2035 bp, Homo sapiens
ttaaagtcgcccccggcgcggagcggaccggcagaggcgggcagaggcggcgagaggcggcgagaggcgggctgaggcggcccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtttccta

SEQ ID NO: 426 - DNA, 60 bp, Homo sapiens
cctcttgagtgtcttggggacagctctttccacccctggaagatggaaataaacctgcgt

SEQ ID NO: 427 - DNA, 3687 bp, Homo sapiens
tccaccattttgctagagaaggccgcggaggctcagagaggtgcgcacacttgccctgagtcacacagcgaatgccctccgcggtcccaacgcagagagaacgagccgatcggcagcctgagcgaggcagtggttagggggggccccggccccggccactcccctcaccccctccccgcagagcgccgcccaggacaggctgggccccaggccccgccccgaggtcctgcccacacacccctgacacaccggcgtcgccagccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaacatggttttgaaatgcttgtggattgagggtaggaggtttggatgggagtgagacagaagtaagtggggttgcaaccactgcaacggcttagacttcgactcaggatccagtcccttacacgtacctctcatcagtgtcctcttgctcaaaaatctgtttgatccctgttacccagagaatatatacattctttatcttgacattcaaggcatttctatcacatatttgatagttggtgttcaaaaaaacactagttttgtgccagccgtgatgctcaggcttgaaatgcattattttgaatgtgaagtaaatactgtacctttattggacaggctcaaagaggttatgtgcctgaagtcgcacagtgaataagctaaaacacctgcttttaacaatggtaccatacaaccactactccattaactccacccacctcctgcacccctccccacacacacaaaatgaaccacgttctttgtatgggcccaatgagctgtcaagctgccctgtgttcatttcatttggaattgccccctctggttcctctgtatactactgcttcatctctaaagacagctcatcctcctccttcacccctgaatttccagagcacttcatctgctccttcatcacaagtccagttttctgccactagtctgaatttcatgagaagatgccgatttggttcctgtgggtcctcagcactattcagtacagtgcttgatgcacagcaggcactcagaaaatactggaggaaataaaacaccaaagatatttgtcaaaaaaaaaaaaaaaaa

SEQ ID NO: 428 - DNA, 60 bp, Homo sapiens
aaacagatataaatggctggtttttagaaacatggttttgaaatgcttgtggattgaggg

SEQ ID NO: 429 - DNA, 2867 bp, Homo sapiens
ggtcccctttcgggcgccatggggcgccgagcgcggcctggcccctcgggctcctctgcggggagggcaggccgcaggctggagcggggtgcggaggctggcggggagcggcccccggaggctttcctggtagaagttgatgcgaggaagggcggcggggaccaggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 430 - DNA, 60 bp, Homo sapiens
aagcagattgatatcacacagactcaaagcaaaggcatgtggaacttctatatttcaaaa

SEQ ID NO: 431 - DNA, 4953 bp, Homo sapiens
gaacgagtgggaacgtagctggtcgcagagggcaccagcggctgcaggacttcaccaagggaccctgaggctcgtgagcagggacccgcggtgcgggttatgctgggggctcagatcaccgtagacaactggacactcaggaccacgccatggaggagctgcaggatgattatgaagacatgatggaggagaatctggagcaggaggaatatgaagacccagacatccccgagtcccagatggaggagccggcagctcacgacaccgaggcaacagccacagactaccacaccacatcacacccgggtacccacaaggtctatgtggagctgcaggagctggtgatggacgaaaagaaccaggagctgagatggatggaggcggcgcgctgggtgcaactggaggagaacctgggggagaatggggcctggggccgcccgcacctctctcacctcaccttctggagcctcctagagctgcgtagagtcttcaccaagggtactgtcctcctagacctgcaagagacctccctggctggagtggccaaccaactgctagacaggtttatctttgaagaccagatccggcctcaggaccgagaggagctgctccgggccctgctgcttaaacacagccacgctggagagctggaggccctggggggtgtgaagcctgcagtcctgacacgctctggggatccttcacagcctctgctcccccaacactcctcactggagacacagctcttctgtgagcagggagatgggggcacagaagggcactcaccatctggaattctggaaaagattcccccggattcagaggccacgttggtgctagtgggccgcgccgacttcctggagcagccggtgctgggcttcgtgaggctgcaggaggcagcggagctggaggcggtggagctgccggtgcctatacgcttcctctttgtgttgctgggacctgaggccccccacatcgattacacccagcttggccgggctgctgccaccctcatgtcagagagggtgttccgcatagatgcctacatggctcagagccgaggggagctgctgcactccctagagggcttcctggactgcagcctagtgctgcctcccaccgatgccccctccgagcaggcactgctcagtctggtgcctgtgcagagggagctacttcgaaggcgctatcagtccagccctgccaagccagactccagcttctacaagggcctagacttaaatgggggcccagatgaccctctgcagcagacaggccagctcttcgggggcctggtgcgtgatatccggcgccgctacccctattacctgagtgacatcacagatgcattcagcccccaggtcctggctgccgtcatcttcatctactttgctgcactgtcacccgccatcaccttcggcggcctcctgggagaaaagacccggaaccagatgggagtgtcggagctgctgatctccactgcagtgcagggcattctcttcgccctgctgggggctcagcccctgcttgtggtcggcttctcaggacccctgctggtgtttgaggaagccttcttctcgttctgcgagaccaacggtctagagtacatcgtgggccgcgtgtggatcggcttctggctcatcctgctggtggtgttggtggtggccttcgagggtagcttcctggtccgcttcatctcccgctatacccaggagatcttctccttcctcatttccctcatcttcatctatgagactttctccaagctgatcaagatcttccaggaccacccactacagaagacttataactacaacgtgttgatggtgcccaaacctcagggccccctgcccaacacagccctcctctcccttgtgctcatggccggtaccttcttctttgccatgatgctgcgcaagttcaagaacagctcctatttccctggcaagctgcgtcgggtcatcggggacttcggggtccccatctccatcctgatcatggtcctggtggatttcttcattcaggatacctacacccagaaactctcggtgcctgatggcttcaaggtgtccaactcctcagcccggggctgggtcatccacccactgggcttgcgttccgagtttcccatctggatgatgtttgcctccgccctgcctgctctgctggtcttcatcctcatattcctggagtctcagatcaccacgctgattgtcagcaaacctgagcgcaagatggtcaagggctccggcttccacctggacctgctgctggtagtaggcatgggtggggtggccgccctctttgggatgccctggctcagtgccaccaccgtgcgttccgtcacccatgccaacgccctcactgtcatgggcaaagccagcaccccaggggctgcagcccagatccaggaggtcaaagagcagcggatcagtggactcctggtcgctgtgcttgtgggcctgtccatcctcatggagcccatcctgtcccgcatccccctggctgtactgtttggcatcttcctctacatgggggtcacgtcgctcagcggcatccagctctttgaccgcatcttgcttctgttcaagccacccaagtatcacccagatgtgccctacgtcaagcgggtgaagacctggcgcatgcacttattcacgggcatccagatcatctgcctggcagtgctgtgggtggtgaagtccacgccggcctccctggccctgcccttcgtcctcatcctcactgtgccgctgcggcgcgtcctgctgccgctcatcttcaggaacgtggagcttcagtgtctggatgctgatgatgccaaggcaacctttgatgaggaggaaggtcgggatgaatacgacgaagtggccatgcctgtgtgaggggcgggcccaggccctagaccctcccccaccattccacatccccaccttccaaggaaaagcagaagttcatgggcacctcatggactccaggatcctcctggagcagcagctgaggccccagggctgtgggtggggaaggaaggcgtgtccaggagaccttccacaaagggtagcctggcttttctggctggggatggccgatggggcccacattagggggtttgttgcacagtccctcctgttgccacactttcactggggatcccgtgctggaagacttagatctgagccctccctcttcccagcacaggcaggggtagaagcaaaggcaggaggtgggtgagcgggtggggtgcttgctgtgtgaccttgggcaagtcccttgacctttccagcctatatttcctcttctgtaaaatgggtatattgatgataatacccacattacaggatggttactgaggaccaaagatacatgtaaaatagggctttgtaaactccacagggactgttctatagcagtcatcatttgtctttgaacgtacccaaggtcacatagctgggatttgaactgagccgtgcagctgggatttgaaccaggccttctgatttcaaggtccgagctctgtcctctgtcagtcatgcgtccactttcccttcccctgtgactcctcccttccccactctgctcccagcccctaccttgagaccctcttctctgggcccagagagaggcgtcctggtgaggacaaggtacaggcaaggatgatccagggattgggcctgggactcaggcctcctaagtgtttggttcctccctccaaacactcattagttcactcattcattcattccacaaacatttactgagggccccggaatcagtggactccgaggggactgagacaagccctgccctggggtgggggtggggggcaaggtacagttgattctacatttggatagggagtgggggagggtgggaaggtaggggcgggagagtgagggggtttgtaatttattaattgcgtattttctaagagttttcaacatagtttggcttcacacacaacttcaggcccctcatttgagagccattatcctcaactccatctaaactgaatcttggggagaacccagatctgaccaattggggtaggagacagcaggctctccaagaacatgggcaaatttatttttttataaaacaaaaagataaaaagagttgaaagacgtgaaagtggtgagagatggaggaaacagaatcaggaagtggtagaaaagagaggaggtggctgggcgcagtggctcacgtttgtaatcccagcactttgggaggccaagttgggcggatcatttgaggtcaggagtttgagaccagcctggccaacatggtgaaaccccgttactactaaaaatacaaaaattagctgggtgtctcgtggcaggcacctgtaatcccagctacttagaaggctgaggcaagagaatcacctgaacccaggaggtggaggttgcagtgagccaagattgcaccactgcactccagcctgggcaacagagcgagaccctgtctcaaaaaaaaaaaaaaaaaaaaaaaaaaaacggaaggaaacatcagccttgggggccacagactcaacatgtgtgtgtggtggggttccagcccaacatagagtaacattatttgtacctcccaggctagctcagtccatgggaggctctcctgtccctgaaagctgacacccacctttcaccacttcgcccatgctacagttcagtttcctcgtctgtaaaatggggatgataatggtacctaccttgcagtgttgttataaggattaaaggagacagtgcaagaaaaggccttggttggtgaagagcccaacctcggaggggagctgctgggatcctccttatcttgactgggatgtccctgtctccccctccccttgctccttgaacatggccaaggaaagtgaaaaacaaaaattattcactctgctagcacccttccccttgatgcctgggaataggttttgccaataaacgtatctgtgttgga

SEQ ID NO: 432 - DNA, 60 bp, Homo sapiens
cagtccctcctgttgccacactttcactggggatcccgtgctggaagacttagatctgag

SEQ ID NO: 433 - DNA, 1593 bp, Homo sapiens
gcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagtt

SEQ ID NO: 434 - DNA, 60 bp, Homo sapiens
cagtataaaaatgtcaggcctgattatctaaaagctatttggaatgtaatcaactgggag

SEQ ID NO: 435 - DNA, 3093 bp, Homo sapiens
cggggccgaggcgcgaggaggtgaggctggagcgcggccccctcgccttccctgttcccaggcaagctcccaaggcccgggcggcggggccgtcccgcgggccagccagatggcgacgtggcggttccccgcccgccgcgaccccaactccgggacgcacgctgcggacgcctatcctcccccaggccgctgacccgcctccctgcccggccggctcccgccgcggaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcaataactccaaaagacaataacaaaactttgaaacctgccattgctgagtacattgtgaagaaggctaaacaaaggatagctctgcagagatggcaagatgaactcaacagaagaaagaatcataaaggaatgatatttgttgaaaatactgttgatttagagggcccaccttcagacttctattacattaacgaatacaaaccagctcctggaatcagcttagtcaatgaagctacctttggttgttcatgcacagattgcttctttcaaaaatgttgtcctgctgaagctggagttcttttggcttataataaaaaccaacaaattaaaatcccacctggtactcccatctatgaatgcaactcaaggtgtcagtgtggtcctgattgtcccaataggattgtacaaaaaggcacacagtattcgctttgcatctttcgaactagcaatggacgtggctggggtgtaaagacccttgtgaagattaaaagaatgagttttgtcatggaatatgttggagaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaagagggtcagaacagtatgtaaatgtggagctgtgacttgcagaggttacctcaactgaactttttcaggaaatagagctgatgattataatatttttttcctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaattaatttcagcttcatttcgtatttcgaagcaatctagactgttgtgatgagtgtatgtctgaacctgtaattcttaaaagacttcttaatcttctagaagaaaaatctccgaagagctctctctagaagtccaaaatggctagccattatgcttctttgaaaggacatgataatgggaccaggatggttttttggagtaccaagcaaggggaatggagcactttaagggcgcctgttagtaacatgaattggaaatctgtgtcgagtacctctgatctaaacggtaaaacaagctgcctggagagcagctgtacctaacaatactgtaatgtacattaacattacagcctctcaatttcaggcaggtgtaacagttcctttccaccagatttaatatttttatacttcctgcaggttcttcttaaaaagtaatctatatttttgaactgatacttgttttatacataaattttttttagatgtgataaagctaaacttggccaaagtgtgtgcctgaattattagacctttttattagtcaacctacgaagactaaaatagaatatattagttttcaagggagtgggaggcttccaacatagtattgaatctcaggaaaaactattctttcatgtctgattctgagatttctaattgtgttgtgaaaatgataaatgcagcaaatctagctttcagtattcctaatttttacctaagctcattgctccaggctttgattacctaaaataagcttggataaaattgaaccaacttcaagaatgcagcacttcttaatctttagctctttcttgggagaagctagactttattcattatattgctatgacaacttcactctttcataatatataggataaattgtttacatgattggaccctcagattctgttaaccaaaattgcagaatggggggccaggcctgtgtggtggctcacacctgtgatcccagcactttgggaggctgaggtaggaggatcacgtgaggtcgggagttcaagaccagcctggccatcatggtgaaaccctgtctctactgaaaatacaaaaattagccgggcgtggtggcacacgcctgtagtcccagctactcaggaggctgaggcaggagaatcacttgaattcaggaggcggaggttgcagtgagccaagatcataccactgcactgcagcctgagtgacacagtaagactgtctccaaaaaaaaaaaaaaaaaa

SEQ ID NO: 436 - DNA, 60 bp, Homo sapiens
ggctttgattacctaaaataagcttggataaaattgaaccaacttcaagaatgcagcact

SEQ ID NO: 437 - DNA, 2932 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacaggagcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcggggtacgtggtgcgaggggtggccgcggtggaaatgtaggaggaaagcgcaaagctgatgggtacaaccagccagattccaagcggcgccagaccaataatcagaactggggctcccaacccattgctcagcaaccgctccaaggtggtgatcattctggtaactatggttacaaatctgaaaaccaggagttttatcaggatacttttgggcaacagtggaagtagaaacagtagggcctctgtaaaattggagactgataggttgatcagaaactcaccctaaatctgaacgggtgccgctataatttgtgacatctggcaagatttccctttatgtatatattttaacaatccgcttggacacgaacaaagccacacttctaactgcttctggcgaactgattttatttttaatttttttcaataaagatattcttagatactgaaagaaatagttaatgagtttgcatttgtgcttgagaaaatttggctcaagtccatttggctgtagtgtcaacgatgtttccagtagtgtttagatttggtgtcttcaaaggtagttgattaaaaccaagtgtgtctttaatatcttgtatcagaataactttgtatgttaccaacttaaattgctagaataaggtaaattgatacacaactgctatttttaatttagaactttgacctaatttgggttttcaaaaccattttggctacttgtattctttatgctgttgtttatttcaataaaaaattcacacct

SEQ ID NO: 438 - DNA, 60 bp, Homo sapiens
accttcctatgaagatcatggaatcaaatacgggacattgaactaatacttggactttga

SEQ ID NO: 439 - DNA, 2098 bp, Homo sapiens
cggggcagctcacgcttcctaaatcccgtcatccagtgagaaagcagggactcttcggcctaggcagccgggacccagccagccctgcgcctcgcgccgtcgcgcatgcgtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagggggccgtgaccaccgcctccccgcgacgccccagtccagtggcctcgcgtccgcccattcagcggagacctgcggagaggcggcggccgcggcctccgcaagccgtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccattaaaaaaaaaaa

SEQ ID NO: 440 - DNA, 60 bp, Homo sapiens
agccatcttacttggctttttactattaacatgatgtactaaagtagagccctttgagaa

SEQ ID NO: 441 - DNA, 1254 bp, Homo sapiens
ccttcagcgcctcggctccagcgccatggcgccctccaggaagttcttcgttgggggaaactggaagatgaacgggcggaagcagagtctgggggagctcatcggcactctgaacgcggccaaggtgccggccgacaccgaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctggggcactcagagagaaggcatgtctttggggagtcagatgagctgattgggcagaaagtggcccatgctctggcagagggactcggagtaatcgcctgcattggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggcccaggaagtacacgagaagctccgaggatggctgaagtccaacgtctctgatgcggtggctcagagcacccgtatcatttatggaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactaggaaaaaaaaaaaaaaaaaaaaaaaaaaaaaaaaaa

SEQ ID NO: 442 - DNA, 60 bp, Homo sapiens
tatcttcaccctgtaatggttgggaccaggccaatcccttctccacttactataatggtt

SEQ ID NO: 443 - DNA, 1284 bp, Homo sapiens
ggctccttcgggaaacccagccccgtcaccgggctccgagcggctcgcaggcgagcgacagcggcctcagccccggcagcgcccagcggcggctgcggaaagcggagggagtccgacgcgggcgcgggcggggagcgtgcgtccgttcgcacaggcagcgggaggaggggcggcgcgaaccatggccggggacagcgagcagaccctgcagaaccaccagcagcccaacggcggcgagcccttccttataggcgtcagcgggggaacagctagcggcaagtcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccggaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagttataaatacatatatatataaaaaaaaaaaaaaaaaaaaaaaaaaaaaaaaaaaaaaaa

SEQ ID NO: 444 - DNA, 60 bp, Homo sapiens
gctcatctgtacatactgtttcctatgacattactgtatttaagaaaacaccatggagat

SEQ ID NO: 445 - DNA, 4602 bp, Homo sapiens
ggaggtgtcgcgccggggaacttcctggttcccgggctcggcttcgccgggatcctcttggaagggaaacaatggggcggagggcactgcggtagccgccgccgccgccgcgccgcgccgcgccggatctgctcggccgcccgggaccgccagctctgtccgctgcccacagcctagcagtcgggaccgtactgaggacatgtattcctctgagaaaccttggacagcagattttggtttaatatctgattgggacaacattcagacccatttccagtcatgaattcagaccaggatgtagcactcaaacttgcccaggagcgagctgaaatagttgctaaatatgacagaggacgagaaggtgcagagattgaaccttgggaagatgctgattaccttgtttacaaagtcacagatagatttggctttttacatgaggaggagctcccagatcataatgtggctgtggaacggcaaaagcacctggaaattgaaagaactaccaaatggctgaaaatgctgaaaggatgggaaaaatacaagaacactgaaaagtttcataggcgaatttacaaaggaataccactccagctcagaggtgaagtctgggccctccttcttgagatccctaaaatgaaagaagaaacaagggacctgtatagtaaattaaaacacagagcacggggctgttcacctgacatcagacaaatagacctggatgtcaaccgcacatttcgggaccacattatgtttagagacagatatggtgttaagcaacaatccttattccatgtgcttgctgcctattctatttataacacggaagtcgggtattgtcaggggatgagccagatcacagctttactcctcatgtatatgaacgaggaagatgccttctgggccctggtcaaactcttctcaggccctaaacatgccatgcatggcttttttgtccaaggttttcctaaactcttgaggtttcaagaacatcatgaaaaaatactgaacaaatttctgtccaagcttaagcaacacttggattctcaagaaatctacacaagtttttacacaatgaaatggttttttcagtgtttccttgatcgtactccctttacactaaacctcagaatatgggatatctacatctttgaaggagaacgagttcttactgctatgtcttacaccatcttaaaattacacaaaaaacatctaatgaaattgtccatggaagaacttgtagaattttttcaggagaccctggcaaaggattttttctttgaagatgattttgtgatagagcaacttcagatttctatgacagaactaaagcgggcaaagttagaccttccagaacctggtaaagaggatgaatatccaaagaagcccttggggcagcttccacctgaacttcagtcttggggcgtccatcacttgagcaacggacagaggagcgtgggccggccgagcccgctggccagcggcaggagggagagcggggcgccccacaggaggcacgagcactccccgcacccccagagcaggaccgggacgcccgagagagcacagccgccaagacggaaatcggtggaggaggagagcaaaaagcttaaagatgaggcagattttcaaagaaaactcccatcgggtccacaggacagttccaggcaatataatcacgcagctgccaaccaaaatagcaacgccacttcaaatatcaggaaggagtttgtgcccaaatggaataaaccgtcagacgtctcagctacagagagaactgccaaatacaccatggaaggcaaaggtcgagcagcgcaccccgcgctcgcagttaccgtcccaggtcctgccgaggtgcgggtgtcaaacgtgcggccaaagatgaaggccctggatgctgaggacgggaagcggggctccactgcatcgcagtacgacaacgtgccaggcccggagctggacagcggcgcttccgtggaggaggcgctggaaagggcttactcccagagcccccggcatgccctttaccctcccagcccgagaaagcacgctgagccaagttctagtccatcaaaagtatccaacaagtttacttttaaagtacagcctccaagtcatgcacgatatccgtcccagctagatggggaagcccgagggctagctcatcccccctcctacagcaatccccccgtttaccacggaaactctcccaaacacttccctactgccaacagcagctttgcttctccacagtttagccctgggactcaactgaatccttccaggagacctcatggttctactctttccgtcagtgcttctccggagaaatcttacagccgcccaagcccccttgtactgccgtctagtcgaatagaagtcctccctgttgacactggtgctgggggatattcgggcaattcagggtcaccaaagaatggaaaattgatcattccaccagtggattacttgccagataacagaacatggtcagaagttagttatacatacagacctgagacgcagggacaatcatggacccgagatgctagccgtggcaatttaccaaaatactcagcctttcaactcgcaccctttcaggaccatggcctccctgcagtttctgtagatagtcccgtgagatataaagcttcaccggccgcagaagatgccagtccatctggatatccatattcagggcccccgcctccagcctaccactacaggaatcgggacgggctttccatccaagagtcagtgttgctgtgagatttgacgtgtacttgctaaagacgagagagaaaccacgtgaaacctacattgctatgttcataattgccaaagcagtatttatactattgtaaacaactcgcacatctctcctgtctgttagtaataagaatacagggaaatgtcttcagccccacgtagatgctgcttaagatgagcgtttcaattgcatcatcactgacctgtagaatttaacccggaaacatcgcaatagcatttagggatgcacgcacagtggtaatttattactcagttccggttatgtttttctccaaaacctgaacatttttactctgttggctcattctattttgactaatgttacaaagtactgaaaaaactgtagaatagatatttttaaggctatatgtagtgtatgtgtcttttaatagatataggcatctgttcatccacatttgaacacagagctaaagaaacgttttttaaaaaactacttttaatccagatccatggaataatatgtaattcttgttttccttgtcttttagtccagtttttctttttccctctcatatatttgtaacctgggtcctaaactgactgaagagtttgtcctgactttattaattgcagtctcacagaatgctcatcattctccttcagctgttgccattttctttcaatctgaaaattaaagacattggagagaaaggctaaccacttaatggtgcttaaaaatcggggcacttaaaataagtttacggccaaaggtgcagcagtgcttatcacatccacatactaagagattggtcttagtgcgtttgtgccctttgttctggtctgactcttgcgaatctcagagcaggagaagttgcagcttactgatccctcagtgctcacagtactcatgtggggcagccacactaactgcattagcagtgtggttacttctttcttctgcctcgactcacatggcttctccccacgaaggtcccagggtggccatttatacaatccatttctgtcctctttatggaatgtagtcgacggatattgctgcacctcatcaggccattacattgtccatgttaaaattataaaaatgatcctagtttttcataggagtctaggattttgatcttttaaaaaatacagtgtgatttcatgcttttgaacatctttttttttttcattgaaacaaattcaagttcttggcttaaaaaaaaattagtgatgtctttaaaaaatattctgttacactacagataccaaaacactgacaaagatttaggcactccaagagagtatgacttcgtgtttaattggggagcttgttttcaacattgcttatatttgaatagtagaaaacccgacattgatgtttcttcctgttgcaaggtggggctttaaactttcaaggtacaaaagtatgtcttttaaaatggaagtaacgtttgtttagctagtgaatgtgacaatatattttatgtatataatgagtctaatgtaattttgatcaacttggtaatgatgttattaaatagcaaaacaagtgcagtgtattaaagctaaacactacattgaaacgcaaacaaaattctggtgaaataactgggctgttgatgcaggtcaggtggaagctgagaaataaatgtatataaatatgtagctgaggatattaattcccattatataaccataattctgtgacttgtaataaaccaagctgtacaatttagtttataatagcagtatctgagctgctccaaaatatatatatcaacagtggtaaatactgtagatttttatatatatatatatatatatgcaaaaaatatatatatacacacaagc

SEQ ID NO: 446 - DNA, 60 bp, Homo sapiens
gataccaaaacactgacaaagatttaggcactccaagagagtatgacttcgtgtttaatt

What is claimed is:

1. A method for identifying a subject harboring a tumor who is predicted to respond to an agent that modulates a PI3K growth factor signaling pathway, said method comprising:
   (a) isolating a tumor cell sample from a subject;
   (b) calculating a signature score which represents the regulation status of PI3K growth factor pathway signaling of the tumor by a method comprising:
      (i) measuring the a) expression level of each of a first plurality of genes and each of a second plurality of genes in an isolated tumor cell sample, wherein first plurality of genes has at least 3 or more of the genes for which biomarkers are listed in Table 5a, wherein the at least 3 genes include TRIP13, TOMM40 and CTPS, and said second plurality of genes has at least 3 or more of the genes for which biomarkers are listed in Table 5b, wherein the at least 3 genes include MST1, CTDSP2 and FANK1;
      (ii) measuring the expression level of each of said first plurality of genes and each of said second plurality of genes in a control cell sample;
      (iii) calculating the differential expression values of each of said first plurality of genes in (i) relative to each of said first plurality of genes in (ii), and calculating the mean differential expression value for said first plurality of genes;
      (iv) calculating the differential expression value of each of said second plurality of genes in (i) relative to each of said second plurality of genes in (ii), and calculating the mean differential expression value for said second plurality of genes; and,
      (v) calculating the signature score by subtracting said mean differential expression value of said second plurality of genes from said mean differential expression value of said first plurality of genes; and
   (c) classifying said tumor as having a deregulated growth factor signaling pathway if said obtained signature score is above a predetermined threshold, and ii) if said signature score is statistically significant;
wherein a subject harboring a tumor classified as having a deregulated growth factor signaling pathway is identified as a subject who is predicted to respond to an agent that modulates a PI3K growth factor signaling pathway, and wherein steps (b) and (c) are displayed or outputted to a user interface device, a computer readable storage medium, or a local or remote computer system.

2. The method of claim 1, wherein said first plurality of genes includes at least 5 of the genes for which biomarkers are listed in Table 9a and said second plurality of genes includes at least 5 genes for which biomarkers are listed in Table 9b.

3. The method of claim 2, wherein the first plurality of genes consist of all of the genes for which biomarkers are listed in Table 9a and the second plurality of genes consist of all of the genes for which biomarkers are listed in Table 9b.

4. The method of claim 1, wherein said differential expression value is log(10) ratio.

5. The method of claim 1, wherein said predetermined threshold is 0.

6. The method of claim 1, wherein said signature score is statistically significant if it has a p-value less than 0.05.

7. The method of claim 1, wherein the subject is a human.

* * * * *